US008236326B2

(12) United States Patent
Bakshi et al.

(10) Patent No.: US 8,236,326 B2
(45) Date of Patent: Aug. 7, 2012

(54) ***KLEBSIELLA* ANTIGENS**

(75) Inventors: Sharmila Bakshi, Vienna (AT); Thomas Cipps, Vienna (AT); Markus Hanner, Pressbaum (AT); Jutta Pikalo, Strau (AT); Christina Satke, Moedling (AT); Eszter Nagy, Vienna (AT); Urban Lundberg, Dresden (DE); Dagmar Zierer, Vienna (AT); Andreas Meinke, Pressbaum (AT); Birgit Noiges, Vienna (AT); Ulrike Stierschneider, Vienna (AT); Alexander von Gabain, Vienna (AT)

(73) Assignee: Intercell AG, Vienna (AT)

( * ) Notice: Subject to any disclaimer, the term of this patent is extended or adjusted under 35 U.S.C. 154(b) by 4 days.

(21) Appl. No.: 12/598,176

(22) PCT Filed: Apr. 29, 2008

(86) PCT No.: PCT/EP2008/055214
§ 371 (c)(1),
(2), (4) Date: Sep. 23, 2010

(87) PCT Pub. No.: WO2008/135446
PCT Pub. Date: Nov. 13, 2008

(65) Prior Publication Data
US 2011/0236410 A1  Sep. 29, 2011

(30) Foreign Application Priority Data

May 2, 2007  (EP) .................................... 07107344

(51) Int. Cl.
*A61K 39/108* (2006.01)
*A61K 39/02* (2006.01)
*C07K 14/26* (2006.01)

(52) U.S. Cl. .................. 424/259.1; 424/190.1; 530/300; 530/350

(58) Field of Classification Search ........................ None
See application file for complete search history.

(56) References Cited

U.S. PATENT DOCUMENTS

| 4,946,778 | A | 8/1990 | Ladner et al. |
| 5,849,902 | A | 12/1998 | Arrow et al. |
| 5,989,912 | A | 11/1999 | Arrow et al. |
| 6,605,713 | B1 | 8/2003 | Furste et al. |
| 6,610,836 | B1 * | 8/2003 | Breton et al. ................. 536/23.1 |

FOREIGN PATENT DOCUMENTS

| DE | 197 42 706 | 4/1999 |
| EP | 0 464 533 | 1/1992 |
| EP | 0 533 838 | 3/1993 |
| GB | 2 188 638 | 10/1987 |
| WO | WO 86/01533 | 3/1986 |
| WO | WO 90/07861 | 7/1990 |
| WO | WO 91/18088 | 11/1991 |
| WO | WO 96/02555 | 2/1996 |
| WO | WO 97/30721 | 8/1997 |
| WO | WO 98/08856 | 3/1998 |
| WO | WO 99/38528 | 8/1999 |
| WO | WO 01/24822 | 4/2001 |
| WO | WO 01/54720 | 8/2001 |
| WO | WO 01/78767 | 10/2001 |
| WO | WO 01/93903 | 12/2001 |
| WO | WO 01/93905 | 12/2001 |
| WO | WO 02/13857 | 2/2002 |
| WO | WO 02/32451 | 4/2002 |
| WO | WO 02/095027 | 11/2002 |
| WO | WO 03/047602 | 6/2003 |

OTHER PUBLICATIONS

Holmes , Exp. Opin.Invest. Drugs, 2001, 10(3):511-519).*
Greenspan et al (Nature Biotechnology, 1999, 7:936-937).*
Kurupati et al 2006, Proteomics vol. 6, pp. 836-844.*
Alcántar-Curiel et al., "*Klebsiella pneumoniae* 35 and 36 kDa Porins Are Common Antigens in Different Stereotypes and Induce Opsonizing Antibodies," *Arch. Med. Res.* 31:28-36 (2000).
Altschul et al., "Basic Local Alignment Search Tool," *J. Mol. Biol.* 215:403-410 (1990).
Amit et al., "Three-Dimensional Structure of an Antigen-Antibody Complex at 2.8 ç Resolution," *Science* 233:747-753 (1986).
Bennett et al., "Kinetic Characterization of the Interaction of Biotinylated Human Interleukin 5 with an Fc Chimera of its Receptor α Subunit and Development of an ELISA Screening Assay Using Real-Time Interaction Biosensor Analysis," *J. Mol. Recognit.* 8:52-58 (1995).
Carter et al., "Improved Oligonucleotide Site-Directed Mutagenesis Using M13 Vectors," *Nucl. Acids Res.* 13:4431-4443 (1985).
Clackson et al., "Making Antibody Fragments Using Phage Display Libraries," *Nature* 352:624-628 (1991).
Cohen et al., "Naked DNA Points Way to Vaccines," *Science* 259:1691-1692 (1993).
Cryz et al., "Safety and Immunogenicity of a Polyvalent *Klebsiella* Capsular Polysaccharide Vaccine in Humans," *Vaccine* 4:15-20 (1986).
Devereux et al., "A Comprehensive Set of Sequence Analysis Programs for the VAX," *Nucl. Acids Res*.12:387-395 (1984).
Doherty et al., "Ribozyme Structures and Mechanisms," *Annu. Rev. Biophys. Biomol. Struct.* 30:457-475 (2001).

(Continued)

*Primary Examiner* — Padma Baskar
(74) *Attorney, Agent, or Firm* — Wolf, Greenfield & Sacks, P.C.

(57) ABSTRACT

The present invention relates to isolated nucleic acid molecules which encode an antigen, a vector which comprises such nucleic acid molecule, and a host cell comprising such vector. Furthermore, the invention provides antigens from a *Klebsiella* species, as well as fragments and variants thereof, a process for producing such antigens, and a process for producing a cell, which expresses such antigen. Moreover, the present invention provides antibodies binding to such antigen, a hybridoma cell producing such antibodies, methods for producing such antibodies, a pharmaceutical composition comprising such nucleic acid molecule, antigen, vector or antibody, the use of such nucleic acid molecule, antigen, vector or antibody for the preparation of a pharmaceutical composition, methods for identifying an antagonist capable of binding such antigen or of reducing or inhibiting the interaction activity of such antigen, methods for diagnosing an infection and methods for the treatment or prevention of an infection. More specifically such antigens are produced by or associated with bacterial pathogens causing nosocomial infections or bacterial infections caused by *Klebsiella pneumoniae*.

11 Claims, 11 Drawing Sheets

OTHER PUBLICATIONS

Eisenbraun et al., "Examination of Parameters Affecting the Elicitation of Humoral Immune Responses by Particle Bombardment-Mediated Genetic Immunization," *DNA Cell Biol.* 12:791-797 (1993).

Etz et al., "Bacterial Phage Receptors, Versatile Tools for Display of Polypeptides on the Cell Surface," *J. Bacteriol.* 183:6924-6935 (2001).

Ganz et al., "Defensins and Host Defense," *Science* 286:420-421 (1999).

Georgiou et al., "Display of Heterologous Proteins on the Surface of Microorganisms: From the Screening of Combinatorial Libraries to Live Recombinant Vaccines," *Nat. Biotechnol.* 15:29-34 (1997).

Haeggman et al., "An Allelic Variant of the Chromosomal Gene for Class A β-Lactamase K2, Specific for *Klebsiella pneumoniae*, Is the Ancestor of SHV-1," *Antimicrob. Agents Chemother.* 41:2705-2709 (1997).

Hashemzadeh-Bonehi et al., "Importance of Using *lac* Rather Than *ara* Promoter Vectors for Modulating the Levels of Toxic Gene Products in *Escherichia coil*," *Mol. Microbiol.* 30:676-678 (1998).

Hemmer et al., "Identification of Candidate T-Cell Epitopes and Molecular Mimics in Chronic Lyme Disease," *Nat. Med.* 5:1375-1382 (1999).

Hornef et al., "Bacterial Strategies for Overcoming Host Innate and Adaptive Immune Responses," *Nat. Immunol.* 3:1033-1040 (2002).

Huse et al., "Generation of a Large Combinatorial Library of the Immunoglobulin Repertoire in Phage Lambda," *Science* 246:1275-1281 (1989).

Ishibashi et al., "Hypercholesterolemia in Low Density Lipoprotein Receptor Knockout Mice and its Reversal by Adenovirus-Mediated Gene Delivery," *J. Clin. Invest.* 92:883-893 (1993).

Johanson et al., "Binding Interactions of Human Interleukin 5 With Its Receptor α Subunit," *J. Biol. Chem.* 270:9459-9471 (1995).

Jones et al., "Replacing the Complementarity-Determining Regions in a Human Antibody With Those From a Mouse," *Nature* 321:522-525 (1986).

Kajava et al., "The Net Charge of the First 18 Residues of the Mature Sequence Affects Protein Translocation Across the Cytoplasmic Membrane of Gram-Negative Bacteria," *J. Bacteriol.* 182:2163-2169 (2000).

Kay et al., "In vivo Hepatic Gene Therapy: Complete Albeit Transient Correction of Factor IX Deficiency in Hemophilia B Dogs," *Proc. Natl. Acad. Sci.* USA 91:2353-2357 (1994).

Kohler et al., "Continuous Cultures of Fused Cells Secreting Antibody of Predefined Specificity," *Nature* 256:495-497 (1975).

Kolaskar et al., "A Semi-Empirical Method for Prediction of Antigenic Determinants on Protein Antigens," *FEBS Lett.* 276:172-174 (1990).

Kurupati et al., "Identification of Vaccine Candidate Antigens of an ESBL Producing *Klebsiella pneumoniae* Clinical Strain by Immunoproteome Analysis," *Proteomics* 6:836-844 (2006).

Lewin et al., "Ribozyme Gene Therapy: Applications for Molecular Medicine," *Trends Mol. Med.* 7:221-228 (2001).

Marks et al., "By-Passing Immunization: Building High Affinity Human Antibodies by Chain Shuffling," *Biotechnology (NY)* 10:779-783 (1992).

McCafferty et al., "Phage Antibodies: Filamentous Phage Displaying Antibody Variable Domains," *Nature* 348:552-554 (1990).

Nagy et al., "Identification of the Antigenome—A Novel Tool for Design and Development Against Bacterial Pathogens." *Genomics, Proteomics and Vaccines*, England: John Wiley & Sons Ltd., pp. 179-199 (2003).

Okano et al., "Myelin Basic Protein Gene and the Function of Antisense RNA in Its Repression in Myelin-Deficient Mutant Mouse," *J. Neurochem.* 56:560-567 (1991).

Podschun et al., "*Klebsiella* spp. As Nosocomial Pathogens: Epidemiology, Taxonomy, Typing Methods, and Pathogenicity Factors," *Clin. Microbiol. Rev.* 11:589-603 (1998).

Queen et al., "A Humanized Antibody That Binds to the Interleukin 2 Receptor," *Proc. Natl. Acad. Sci.* USA 86:10029-10033 (1989).

Rammensee et al., "SYFPEITHI: Database for MHC Ligands and Peptide Motifs," *Immunogenetics* 50:213-219 (1999).

Riechmann et al., "Reshaping Human Antibodies for Therapy," *Nature* 332:323-327 (1988).

Seeger et al., "The Cloned Genome of Ground Squirrel Hepatitis Virus is Infectious in the Animal," *Proc. Natl. Acad. Sci.* USA 81:5849-5852 (1984).

Skerra et al., "Use of the Tetracycline Promoter for the Tightly Regulated Production of a Murine Antibody Fragment in *Escherichia coli*," *Gene* 151:131-135 (1994).

Tang et al., "Genetic Immunization Is a Simple Method for Eliciting an Immune Response," *Nature* 356:152-154 (1992).

Tempest et al., "Reshaping A Human Monoclonal Antibody to Inhibit Human Respiratory Syncytial Virus Infection In vivo," *Biotechnology (NY)* 9:266-271 (1991).

Tourdot et al., "A General Strategy to Enhance Immunogenicity of Low-Affinity HLA-A2.1-Associated Peptides: Implication in the Identification of Cryptic Tumor Epitopes," *Eur. J. Immunol.* 30:3411-3421 (2000).

Trautmann et al., "O Antigen Seroepidemiology of Klebsiella Clinical Isolates and Implications for Immunoprophylaxis of Klebsiella Infections," *Vaccine* 22:818-821 (2004).

Ueda et al., "In Vitro and In Vivo Antibacterial Activities of SM-216601, A New Broad-Spectrum Parenteral Carbapenem," *Antimicrob. Agents Chemother.* 49:4185-4196 (2005).

Wells et al., "Cassette Mutagenesis: An Efficient Method for Generation of Multiple Mutations at Defined Sites," *Gene* 34:315-323 (1985).

Wu et al., "Identification of a Novel Cephalosporinase (DHA-3) in *Klebsiella pneumoniae* Isolated in Taiwan," *Clin. Microbiol. Infect.* 11:893-897 (2005).

Zoller et al., "Oligonucleotide-Directed Mutagenesis Using M13-Derived Vectors: An Efficient and General Procedure for the Production of Point Mutations in any Fragment of DNA," *Nucl. Acids Res.* 10:6487-6500 (1982).

\* cited by examiner

KPORF-54

KLEBSIELLA ANTIGENS

CROSS REFERENCE TO RELATED APPLICATIONS

This application is the U.S. National Stage of International Application No. PCT/EP2008/055214, filed Apr. 29, 2008, which claims the benefit of European Patent Application No. 07107344.9, filed May 2, 2007, each of which is hereby incorporated by reference.

The present invention relates to isolated nucleic acid molecules which encode an antigen, a vector which comprises such nucleic acid molecule, and a host cell comprising such vector. Furthermore, the invention provides antigens from a *Klebsiella* species, as well as fragments and variants thereof, a process for producing such antigens, and a process for producing a cell, which expresses such antigen. Moreover, the present invention provides antibodies binding to such antigen, a hybridoma cell producing such antibodies, methods for producing such antibodies, a pharmaceutical composition comprising such nucleic acid molecule, antigen, vector or antibody, the use of such nucleic acid molecule, antigen, vector or antibody for the preparation of a pharmaceutical composition, methods for identifying an antagonist capable of binding such antigen or of reducing or inhibiting the interaction activity of such antigen, methods for diagnosing an infection and methods for the treatment or prevention of an infection. More specifically such antigens are produced by or associated with bacterial pathogens causing nosocomial infections or bacterial infections caused by *Klebsiella pneumoniae*.

*Klebsiella pneumoniae* (*K. pneumoniae*) is a gram negative, facultative anaerobic bacterium. Strains of *K. pneumoniae* are distinguished by the presence of a capsular polysaccharide, of which there are 77 antigenic types. This capsule encases the entire cell surface, accounts for the large appearance of the organism on gram stain, and provides resistance against many host defense mechanisms. Colonies are large and highly mucoid. *Klebsiella pneumoniae* has the ability to fix nitrogen i.e. to convert atmospheric nitrogen gas to ammonium.

*Klebsiellae* have two common habitats, one being the environment, where they are found in surface water, sewage and soil, and the other being the mucosal surface of mammals such as humans, horses or swine, which they colonize. In human, *K. pneumoniae* is present as a saprophyte in the respiratory, intestinal and urogenital tracts. When *Klebsiella* bacteria get outside of the gut, however, serious infection can occur.

*Klebsiella pneumoniae* is a common hospital-acquired pathogen, causing urinary tract infections, nosocomial pneumonia, intraabdominal infections, surgical wound infections and infection of the blood. All of these infections can progress to shock and death if not treated early in an aggressive fashion. *K. pneumoniae* is also a potential community-acquired pathogen. It is estimated that *Klebsiella* spp. account for 8% of endemic hospital infection and 3% of epidemic outbreaks (Stamm E. et al., 1981).

*Klebsiella*'s pathogenicity can be attributed to its production of a heat-stable enterotoxin. The virulence factors of *K. pneumoniae* identified so far include capsular polysaccharides (CPS), lipopolysaccharides, adhesins (type 1 and 3 pili, KPF-28 fimbria, CF29K and aggregative adhesin) and iron acquisition systems (Podschun R et al., 1998).

*K. pneumoniae* infections are common in hospitals where they cause pneumonia (characterized by emission of bloody sputum) and urinary tract infections in catheterized patients. In fact, *K. pneumoniae* is second only to *E. coli* as a urinary tract pathogen. It accounts for 6 to 17 percent of all nosocomial urinary tract infection (UTI). *Klebsiella* infections are encountered far more often now than in the past. This is probably due to the bacterium's antibiotic resistance properties. *Klebsiella* species may contain resistance plasmids (R-plasmids) which confer resistance to such antibiotics as Ampicillin and Carbenicillin (Wu et al., 2005). To make matters worse, the R-plasmids can be transferred to other enteric bacteria not necessarily of the same species. Hospital outbreaks of multidrug-resistant *Klebsiella* spp. are often caused by a new type of strain, an ESBL producer (extended spectrum β-lactamase). The incidence of ESBL-producing strains among clinical *Klebsiella* isolates has been steadily increasing over the past several years. Frequencies of up to 40% have been reported in certain regions. To treat *K. pneumoniae* infections, there are few antibiotics available like Cefepime, Polymyxin B (Parchuri et al., 2005), Carbapenem (Meropenem and Imipenem) (Ueda Y. et al., 2005).

There are attempts to develop a vaccice against *Klebsiella*. Among the different bacterial constituents, two surface components are mainly being discussed as candidates for an anti-*Klebsiella* vaccine: LPS and CPS (Yadav et al., 2005). A great drawback of active immunization with LPS-containing vaccines is the induction of adverse toxic reactions, which are caused by the endotoxin content. CPS has been proven to be highly immunogenic and nontoxic. However, the serious disadvantage of a *Klebsiella* CPS vaccine is the great number of different K antigens (77 as of today). There is a 6-valent *Klebsiella* CPS vaccine that subsequently was proven to be safe and immunogenic (Cryz et al., 1986), but covers only 30% of *Klebsiella* blood isolates, while a 25-valent vaccine would cover not more than 75%. Moreover, the production of such multivalent vaccines is difficult and expensive. To overcome this circumstance, protein based vaccines against *Klebsiella* have to be developed. Kurupati et al. (2006) have identified a number of immunogenic antigens from *Klebsiella pneumoniae*, and two of the candidate genes, namely OmpA and FepA, have been further characterized in an in vivo mouse model. However, there are currently no prophylactic *Klebsiella* vaccines on the market or, according to public information, in active preclinical or clinical development. The *Klebsiella* vaccine development program (Klebgen Berna®) at Berna Biotech has been discontinued.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short, usually 8-11 amino acids long peptides in conjunction with major histocompatibility complex (MHC). B-cells can recognize linear epitopes as short as 4-5 amino acids, as well as three-dimensional structures (conformational epitopes). In order to obtain sustained, antigen-specific immune responses, adjuvants need to trigger immune cascades that involve all cells of the immune system. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

There have been concerns to develop an inactivated whole cell vaccine for humans because of the potential risk, that it may induce cross-reactive antibodies to human antigens. Therefore, subunit vaccines are considered to have the greatest potential in preventing infections by *Klebsiella pneumoniae*.

The problem underlying the present invention was to provide means for the development of pharmaceutical compositions such as vaccines against nosocomial infections caused by *Klebsiella*. More particularly, the problem was to provide an efficient, relevant and comprehensive set of nucleic acid molecules or antigens, or fragments or variants thereof, from *Klebsiella* that can be used for the preparation of said pharmaceutical compositions. A still further problem was to provide methods and means for producing an antigen, a fragment or variant thereof. Yet another problem was to provide pharmaceutical compositions comprising said nucleic acids or said antigens. A still further problem of the invention was to provide antibodies, pharmaceutical compositions comprising said antibodies, methods for the production of said antibodies and the use of said antibodies for the preparation of a pharmaceutical preparation. Furthermore, the object of the present invention was to provide methods for identifying an antagonist capable of binding an antigen, or a fragment or variant thereof, as well as to provide methods for identifying an antagonist capable of reducing or inhibiting the interaction activity of such an antigen to its interaction partner. A further problem of the present invention was to provide methods for diagnosing an infection with a *Klebsiella* organism. Still another problem underlying the invention was to provide methods for treating *Klebsiella* infections, and to provide methods for immunizing an animal or human.

The problem underlying the present invention is solved in one aspect by an isolated nucleic acid molecule encoding an antigen or a fragment thereof, comprising a nucleic acid sequence, which is selected from the group consisting of:
  a) a nucleic acid molecule having at least 70% sequence identity to a nucleic acid molecule having a nucleotide sequence selected from the group comprising Seq ID Nos 1 to 187 and Seq ID No 375,
  b) a nucleic acid molecule which is complementary to the nucleic acid molecule of a),
  c) a nucleic acid molecule comprising at least 15 sequential bases of the nucleic acid molecule of a) or b),
  d) a nucleic acid molecule which anneals under stringent hybridisation conditions to the nucleic acid molecule of a), b), or c),
  e) a nucleic acid molecule which, but for the degeneracy of the genetic code, would hybridise to the nucleic acid molecule defined in a), b), c), or d).

In an embodiment of the invention the sequence identity to Seq ID Nos 1 to 187 or Seq ID No 375 is at least 80%, more preferably at least 90%, still more preferably at least 95%, 96%, 97%, 98%, or 99%, or most preferably 100%.

In another embodiment the nucleic acid is DNA.

In an alternative embodiment the nucleic acid is RNA.

In still another embodiment the nucleic acid molecule is isolated from a genomic DNA, preferably from a species selected from the group comprising *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K.*

*pneumoniae* or *K. oxytoca*. The nomenclature or classification of *Klebsiellae* is used herein according to Ørskov, I. (1984).

In an embodiment of the invention the fragment is an active fragment or an active variant thereof.

In an embodiment the nucleic acid encodes an antigen or fragment thereof, which comprises or consists of a polypeptide or peptide fragment from *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The problem underlying the present invention is further solved by a vector comprising a nucleic acid molecule as described above.

In an embodiment the vector is adapted for recombinant expression of the antigen, or fragment thereof, encoded by the nucleic acid molecule as defined above.

The present invention also relates to a host cell comprising the vector as defined above.

The problem underlying the present invention is solved in a further aspect by an antigen that is immunologically reactive with sera from a human having a *Klebsiella* infection, or an uninfected healthy human who was previously infected with *Klebsiella*, wherein the antigen comprises an isolated polypeptide or an active fragment or an active variant thereof from *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The term "uninfected healthy human" as used herein comprises those individuals who have or had multiple encounters with the pathogen, which may result in colonization, but which either do not result in any symptoms, or which result in mild diseases. Said term and the rationale of selecting sera of uninfected healthy humans for antigen identification is further defined in Nagy, E. et al. (2003).

Another aspect of the present invention relates to an antigen, comprising or consisting of an isolated polypeptide selected from the group consisting of Seq ID Nos 188 to 374 and Seq ID No 376, or an active fragment or an active variant thereof.

In an embodiment of the invention said polypeptide is encoded by a nucleic acid molecule as defined above.

In another embodiment the active fragment of the antigen consists of at least 50%, especially at least 60%, preferably at least 70%, more preferably at least 80%, still more preferably at least 90%, even more preferably at least 95%, 96%, 97% or 98%, most preferably 99% of said polypeptide, especially of a polypeptide as defined by any of the Seq ID Nos 188 to 374 or Seq ID No 376.

In another embodiment the active variant of the antigen has at least 50%, especially at least 60%, preferably at least 70%, more preferably at least 80%, still more preferably at least 90%, even more preferably at least 95%, 96%, 97% or 98%, most preferably 99% sequence identity to the polypeptide, especially to a polypeptide as defined by any of the Seq ID Nos 188 to 374 or Seq ID No 376.

In one embodiment of the present invention the active fragment of the antigen comprises or consists of amino acids 2-130 of Seq ID No 205; amino acids 26-356 of Seq ID No 216; amino acids 2-180 of Seq ID No 223; amino acids 1-168 of Seq ID No 224; amino acids 23-397 of Seq ID No 235 amino acids 2-420 and 414-847 of Seq ID No 240; amino acids 582-1099 of Seq ID No 241; amino acids 1-245 of Seq ID No 242; amino acids 24-703 of Seq ID No 247; amino acids 23-328 of Seq ID No 252; amino acids 23-248 of Seq ID No 263; amino acids 2-335 of Seq ID No 267; amino acids 38-633 of Seq ID No 268; amino acids 26-742 of Seq ID No 269; amino acids 26-429 of Seq ID No 281; or amino acids 1-632 of Seq ID No 285. The fragments as listed above are further defined in Seq ID Nos 188 to 203 and 376, (see also Table 16).

In another embodiment, the active variant of the antigen has at least 50%, especially at least 60%, preferably at least 70%, more preferably at least 80%, still more preferably at least 90%, even more preferably at least 95%, 96%, 97% or 98%, most preferably 99% sequence identity to amino acids 2-130 of Seq ID No 205; amino acids 26-356 of Seq ID No 216; amino acids 2-180 of Seq ID No 223; amino acids 1-168 of Seq ID No 224; amino acids 23-397 of Seq ID No 235; amino acids 2-420 and 414-847 of Seq ID No 240; amino acids 582-1099 of Seq ID No 241; amino acids 1-245 of Seq ID No 242; amino acids 24-703 of Seq ID No 247; amino acids 23-328 of Seq ID No 252; amino acids 23-248 of Seq ID No 263; amino acids 2-335 of Seq ID No 267; amino acids 38-633 of Seq ID No 268; amino acids 26-742 of Seq ID No 269; amino acids 26-429 of Seq ID No 281; or amino acids 1-632 of Seq ID No 285.

In still another embodiment, the active variant of the antigen as defined above is derived from the homologous sequence of a different strain and/or serotype of *K. pneumoniae*, particularly wherein the serotype is K1, K2, K3, K10, K21, K22, K30, K55, K64, O1, O2a, O3, O4, O5, or O12, or any combination of said K and said O serotypes.

Examples of variants of KPORF-13 (SEQ ID No 216) are given in Table 8 and SEQ ID Nos 413-451. Examples of variants of KPORF-21 (SEQ ID No 224) are given in Table 9 and SEQ ID Nos 452-500. Examples of variants of KPORF-32 (SEQ ID No 235) are given in Table 10 and SEQ ID Nos 501-540. Examples of variants of KPORF-37 (SEQ ID No 240) are given in Table 11 and SEQ ID Nos 541-579. Examples of variants of KPORF-38 (SEQ ID No 241) are given in Table 12 and SEQ ID Nos 580-617. Examples of variants of KPORF-39 (SEQ ID No 242) are given in Table 13 and SEQ ID Nos 618-667. Examples of variants of KPORF-60 (SEQ ID No 263) are given in Table 14 and SEQ ID Nos 668-717. Examples of variants of KPORF-65 (SEQ ID No 268) are given in Table 15 and SEQ ID Nos 718-765.

Accordingly, in yet another embodiment of the present invention, the active variant of the antigen as defined above is selected from the group consisting of SEQ ID No 413 to 765.

In still another embodiment, the antigen is further defined by
a) 1 to 400 additional amino acid residue(s), preferably 1 to 350, 1 to 300, 1 to 250, or 1 to 200, more preferably 1 to 150, even more preferably at most 1 to 100, still more preferably at most 1 to 50, most preferably 1, 2, 3, 4, 5, 10, 20, 30 or 40 additional amino acid residue(s) to the active fragment of the antigen comprising or consisting of amino acids 2-420 or 414-847 of Seq ID No 240, or to the active variant of the antigen derived from amino acids 2-420 or 414-847 of Seq ID No 240; or
b) 1 to 1100 additional amino acid residue(s), preferably 1 to 1000, 1 to 900, 1 to 800, 1 to 700, 1 to 600, 1 to 500, 1 to 400, or 1 to 300, more preferably 1 to 200, even more preferably at most 1 to 100, still more preferably at most 1 to 50, most preferably 1, 2, 3, 4, 5, 10, 20, 30 or 40 additional amino acid residue(s) to the active fragment of the antigen comprising or consisting of amino acids 582-1099 of Seq ID No 241, or to the active variant of the antigen derived from amino acids 582-1099 of Seq ID No 241.

The additional amino acid residue(s) may be homologous to the antigen as defined above. Homologous refers to any amino acid residue(s) which is/are identical to the amino acid sequence of the *Klebsiella* antigen from which the fragment is derived.

Alternatively or additionally, the polypeptide may comprise or consist of the antigen, optionally the additional sequence as defined above and at least one amino acid residue heterologous to the antigen.

In an embodiment of the invention, the antigen further comprises or consists of at least one amino acid residue heterologous to the antigen, preferably an amino acid sequence of a marker protein.

The additional sequence or amino acid residue(s) as defined above consist(s) of (an) amino acid residue(s), which may be any amino acid, which may be either an L-and/or a D-amino acid, naturally occurring and otherwise. Preferably the amino acid is any naturally occurring amino acid such as alanine, cysteine, aspartic acid, glutamic acid, phenylalanine, glycine, histidine, isoleucine, lysine, leucine, methionine, asparagine, proline, glutamine, arginine, serine, threonine, valine, tryptophan or tyrosine.

However, the amino acid may also be a modified or unusual amino acid. Examples of those are 2-aminoadipic acid, 3-aminoadipic acid, beta-alanine, 2-aminobutyric acid, 4-aminobutyric acid, 6-aminocaproic acid, 2-aminoheptanoic acid, 2-aminoisobutyric acid, 3-aminoisobutyric acid, 2-aminopimelic acid, 2,4-diaminobutyric acid, desmosine, 2,2'-diaminopimelic acid, 2,3-diaminopropionic acid, N-ethylglycine, N-ethylasparagine, hydroxylysine, allo-hydroxylysine, 3-hydroxyproloine, 4-hydroxyproloine, isodesmosine, allo-isoleucine, N-methylglycine, N-methylisoleucine, 6-N-Methyllysine, N-methylvaline, norvaline, norleucine or ornithine. Additionally, the amino acid may be subject to modifications such as posttranslational modifications. Examples of modifications include acetylation, amidation, blocking, formylation, gamma-carboxyglutamic acid hydroxylation, glycosilation, methylation, phosphorylation and sulfatation. If more than one additional or heterologous amino acid residue is present in the peptide, the amino acid residues may be the same or different from one another.

In one embodiment the peptide of the invention further encompasses at least one amino acid residue heterologous to the antigen. The feature "heterologous amino acid" or "amino acid heterologous to the antigen" refers to any amino acid which is different from that amino acid located adjacent to the antigen in any naturally occurring protein of *Klebsiellae*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. Therefore, the protein of the invention encompassing at least one heterologous amino acid refers to a protein which is different from any naturally occurring protein of *Klebsiellae* or fragments thereof, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

In one embodiment, the additional amino acid residue(s) is/are flanking the antigen N-terminally, C-terminally, or N- and C-terminally.

In another embodiment, the invention relates to an antigen as described above, whereby said additional amino acid residue(s) is/are flanking the antigen defined by
a) amino acids 2-420 of Seq ID No 240 or the variant derived thereof C-terminally, b) amino acids 414-847 of Seq ID No 240 or the variant derived thereof N-terminally, or
c) amino acids 582-1099 of Seq ID No 241 or the variant derived thereof N- and/or C-terminally.

In another embodiment, the antigen further comprises or consists of either a leader or a secretory sequence, a sequence employed for purification, or a proprotein sequence.

Another aspect of the present invention relates to an antigen comprising at least one core amino acid sequence as indicated in column "Predicted immunogenic aa" or "Location of identified immunogenic region" of Table 1, or as defined by columns "From aa" and "To aa" of Table 4, or as indicated in column "Location in protein (aa)" of Table 5, whereby more preferably the core amino acid sequence is selected from the group consisting of: amino acids 11-27, 35-47, 68-107, 113-122, 124-136, 140-146, 152-164, 168-174, 183-201, 211-218, 228-243, 246-253 and 180-226 of Seq ID No 204; amino acids 13-31, 48-59, 69-91, 109-115, 121-127 and 46-105 of Seq ID No 205; amino acids 12-44, 49-95, 102-145, 148-178, 184-229, 233-244, 249-273, 292-299, 304-329, 334-348, 354-365, 367-385, 394-426, 428-440, 444-487, 503-527, 531-539, 546-554, 556-584 and 273-286 of Seq ID No 206; amino acids 7-17, 22-32, 34-41, 55-77, 79-86, 93-111, 118-126, 131-148, 152-162, 165-177, 183-197, 213-220, 234-250, 253-262, 267-294 and 211-269 of Seq ID No 207; amino acids 22-29, 41-56, 58-66, 79-88, 94-121, 124-131, 134-157, 162-171, 173-180, 189-197, 201-214, 216-224, 242-254, 257-270, 282-287, 290-302, 309-315, 320-325, 341-355, 362-368, 372-378 and 1-48 of Seq ID No 208; amino acids 5-15, 18-35, 48-61, 65-71, 112-119, 138-154, 157-169, 179-208, 214-223, 226-232, 243-250, 256-262, 277-286, 289-296, 338-348, 352-363, 370-376, 385-408, 420-436, 443-454, 462-483, 498-561, 563-592, 600-642, 661-671, 673-709, 714-733, 748-754, 771-776, 798-806, 808-821, 823-839 and 31-83 of Seq ID No 209; amino acids 5-14, 21-26, 31-41, 59-77, 101-115, 132-145, 147-156, 180-185, 188-197 and 97-158 of Seq ID No 210; amino acids 6-18, 23-43, 45-56, 69-80, 87-97, 112-123, 135-151, 164-171, 178-193, 200-227, 249-258, 262-274, 279-291, 302-308, 322-327, 329-336, 351-363, 366-373, 384-399, 403-411, 415-434, 440-446, 461-482, 488-506, 510-516, 518-551, 574-589, 607-629, 634-665, 667-687, 694-712, 725-739, 743-751, 753-768 and 521-583 of Seq ID No 211; amino acids 4-13, 19-44, 55-63, 71-82, 89-110, 120-130, 132-138, 145-161, 168-182, 189-258, 261-272, 278-288, 290-301 and 11-76 of Seq ID No 212; amino acids 4-22, 43-56, 63-68, 81-90, 93-99, 139-148, 155-160, 170-176, 189-195, 207-218, 227-232, 241-249, 251-258, 260-266, 277-295, 300-327, 329-336, 340-356, 384-390, 418-423, 427-433, 438-444 and 383-428 of Seq ID No 213; amino acids 10-18, 32-37, 45-55, 60-69, 77-83, 89-95, 120-125, 133-170, 172-185, 193-211, 214-223, 232-249, 255-275, 277-303, 305-310, 320-328, 334-341, 347-353, 355-369, 380-386, 389-395 and 71-85 of Seq ID No 214; amino acids 4-23, 27-35, 67-73, 80-103, 117-126, 132-138, 140-159, 162-171, 180-194, 198-208, 211-218, 228-234, 239-253, 262-270, 272-291, 296-305 and 39-110 of Seq ID No 215; amino acids 13-24, 27-34, 37-66, 69-88, 99-104, 149-155, 164-175, 184-193, 199-209, 227-235, 264-273, 276-285, 288-315, 323-335, 346-353, 56-111 and 199-261 of Seq ID No 216; amino acids 11-22, 25-48, 51-60, 64-72, 80-96, 108-122, 132-137, 142-150, 152-167, 175-199, 214-229, 237-244, 252-258, 260-266, 279-287, 301-340, 345-350 and 109-153 of Seq ID No 217; amino acids 37-43, 50-57, 65-82, 87-109, 123-129, 141-150, 152-157, 166-172, 179-203, 209-241, 249-284, 290-300, 308-326, 329-335, 345-357, 359-368, 379-386, 390-417, 420-425, 438-444, 461-466, 473-490, 497-505, 524-534, 541-550, 586-597, 608-614, 622-632, 660-666, 679-694, 696-706, 708-722, 725-731, 737-763, 784-789, 810-825, 837-854, 857-880, 882-895, 901-907, 911-928, 14-76 and 176-220 of Seq ID No 218; amino acids 9-16, 38-52, 61-86, 93-100, 110-117, 123-132, 138-145, 151-169, 172-181, 186-202, 208-225, 227-253, 264-275, 289-295, 320-329, 335-342 and 113-193 of Seq ID No 219; amino acids 11-18, 24-30, 42-49, 53-63, 69-80, 87-93, 95-103, 144-171, 173-185, 193-200, 202-208, 215-221, 242-261, 266-273, 277-286, 290-299, 322-328, 338-351, 354-377, 391-409, 441-451, 461-466, 499-515, 521-527, 562-569, 621-629, 647-663, 676-682, 694-701, 703-713, 725-731, 735-744, 755-764, 793-800 and 490-547 of Seq ID No 220; amino acids 4-11, 14-22, 38-70, 81-90, 97-114, 118-132, 147-171, 173-181, 187-202, 244-250, 252-298, 301-311, 313-331, 342-368, 410-418, 446-451, 456-462, 468-474, 476-492, 499-507, 519-528, 552-565, 568-575, 584-613, 618-624, 626-649 and 417-489 of Seq ID No 221; amino acids 4-9, 32-53, 66-72, 74-90, 97-104, 110-130, 133-139, 144-152, 166-177, 203-213, 215-241, 256-275, 291-304, 307-316, 321-326, 334-345, 352-367 and 201-255 of Seq ID No 222; amino acids 13-19, 26-43, 66-72, 80-85, 95-101, 109-125, 131-137 and 25-107 of Seq ID No 223; amino acids 13-24, 35-43, 50-56, 58-68, 77-83, 104-110, 117-125, 132-138, 140-153 and 19-66 of Seq ID No 224; amino acids 15-31, 37-42, 47-54, 68-87, 89-96, 107-117, 121-127, 131-137, 145-151, 176-182, 220-226, 232-246, 250-257, 291-300, 317-325, 328-333, 337-359, 368-393, 403-428, 460-478, 480-493, 500-506, 511-516, 519-526, 528-559, 565-572, 584-595, 597-605, 608-613, 626-648, 679-684, 687-693, 703-714, 718-735, 742-750, 757-765, 768-788, 793-799, 813-819, 823-829, 839-850 and 576-623 of Seq ID No 225; amino acids 10-35, 37-60, 63-76, 79-86, 88-97, 108-113, 118-126, 128-134, 138-145, 153-159, 168-188, 194-208, 211-243, 255-260, 270-276, 285-301, 307-346, 348-367 and 275-339 of Seq ID No 226; amino acids 4-17, 21-33, 35-42, 47-64, 72-80, 85-92, 98-103, 125-147, 151-161, 165-177, 183-230, 232-246, 256-262, 284-306, 310-328, 331-367, 369-383, 392-399 and 32-85 of Seq ID No 227; amino acids 5-11, 18-27, 42-52, 60-65, 75-84, 90-102, 107-116, 125-178, 184-206, 221-233, 235-242, 249-257, 264-277, 288-317 and 267-313 of Seq ID No 228; amino acids 5-11, 14-42, 50-75, 79-86, 89-98, 120-125, 152-160, 166-181, 185-193, 200-207 and 85-114 of Seq ID No 229; amino acids 4-30, 36-43, 46-55, 63-111, 144-152, 159-168, 179-189, 191-200, 205-213 and 37-109 of Seq ID No 230; amino acids 20-45, 57-77, 80-100, 119-126, 131-137, 143-169, 179-185, 195-203, 207-231, 235-264, 282-302, 320-329, 341-347, 353-359, 361-373 and 266-296 of Seq ID No 231; amino acids 5-22, 24-37, 41-55, 57-65, 72-78, 90-103, 105-116, 119-130, 164-170, 190-202, 209-231, 244-254, 260-276, 300-339, 344-350, 355-376, 389-397, 399-406, 408-421, 429-437 and 103-152 of Seq ID No 232; amino acids 8-16, 18-25, 31-47, 71-82, 87-102, 104-114, 126-156, 176-183, 190-200, 205-212, 218-228, 231-243, 256-279, 287-301, 303-312, 324-332, 335-348, 351-357, 365-380, 395-412, 422-451, 456-464, 467-483, 501-507 and 405-468 of Seq ID No 233; amino acids 4-18, 21-39, 46-56, 63-69, 72-86, 116-130, 132-160, 162-190, 196-201, 209-231, 233-241, 251-265, 269-282, 292-298, 309-324, 333-369, 391-415, 417-427, 436-454, 471-480, 482-499, 510-518, 521-533, 537-543, 545-561, 571-581, 585-597, 599-607, 609-635, 638-643, 650-665, 671-685, 687-695, 701-707, 710-720, 724-736, 747-757, 764-769, 772-784, 791-796, 808-820 and 317-401 of Seq ID No 234; amino acids 4-12, 15-33, 58-77, 82-89, 98-106, 108-118, 120-135, 141-147, 152-160, 168-215, 225-233, 235-247, 250-264, 284-312, 314-321, 336-343, 359-374, 386-394 and 159-218 of Seq ID No 235; amino acids 4-16, 24-36, 40-47, 49-56, 61-81, 84-143, 148-156, 158-164, 170-175, 194-206, 208-214 and 126-203 of Seq ID No 236; amino acids 28-45, 50-61, 94-111, 113-124, 137-142, 147-173, 180-188, 190-196, 202-223, 229-235, 239-249, 262-270, 280-288, 290-321, 325-332, 347-355, 359-368, 389-407, 415-427, 429-453, 458-465, 477-485, 499-505, 516-527, 531-549, 569-592, 594-602, 605-615, 628-635, 647-659, 662-683, 727-735, 760-765, 771-780, 788-809, 811-818 and 549-630 of Seq ID No 237; amino acids 21-28, 33-40, 48-100, 104-111, 113-134 and 1-46 of Seq ID No 238; amino acids 12-24, 31-41, 53-61, 73-87, 112-128, 133-140, 151-156 and 26-98 of Seq ID No 239; amino acids 4-9, 19-26, 32-56, 58-67, 71-81, 90-95, 97-105, 112-118, 124-132, 138-144, 147-167, 169-177, 199-207, 212-217, 231-241, 250-260, 266-272, 274-282, 289-296, 299-310, 316-331, 344-350, 352-363, 368-377, 381-394, 399-406, 412-450, 459-473, 486-503, 508-514, 518-548, 564-570, 579-587, 602-608, 616-623, 628-635, 638-654, 678-688, 691-696, 703-709, 716-723, 761-772, 784-793, 819-826, 835-844 and 790-834 of Seq ID No 240; amino acids 4-10, 18-36, 43-50, 63-71, 75-105, 109-117, 134-140, 145-157, 176-182, 184-201, 203-211, 215-225, 240-250, 262-284, 294-309, 313-319, 327-337, 350-356, 361-367, 372-393, 411-421, 428-451, 453-466, 487-492, 501-528, 535-553, 564-574, 592-605, 612-629, 631-640, 646-653, 658-666, 673-681, 713-718, 720-730, 739-749, 784-792, 821-826, 833-844, 853-863, 871-876, 885-894, 900-918, 937-950, 952-957, 972-990, 995-1001, 1024-1036, 1039-1044, 1049-1055, 1062-1089, 1091-1103, 1110-1121, 1123-1129, 1131-1151, 1157-1179, 1181-1201, 1204-1223, 1233-1244, 1269-1276, 1279-1286, 1294-1301, 1303-1309, 1315-1338, 1350-1362, 1373-1381, 1398-1406, 1412-1423, 1440-1446, 1458-1466, 1481-1487, 1492-1508, 1511-1518, 1528-1534, 1536-1547, 1553-1565, 1606-1617, 1619-1644 and 761-781 of Seq ID No 241; amino acids 6-13, 31-38, 47-60, 71-102, 107-123, 128-155, 173-179, 185-194, 210-220 and 161-232 of Seq ID No 242; amino acids 11-34, 36-43, 49-67, 74-79, 84-92, 94-100, 103-112, 120-129, 134-155, 162-173, 177-185, 189-202, 206-211 and 130-185 of Seq ID No 243; amino acids 4-10, 20-35, 37-46, 48-55, 60-66, 75-82, 87-98, 133-150, 166-172, 178-189, 208-214, 230-235, 245-251, 271-308, 319-333, 335-355, 373-380 and 117-201 of Seq ID No 244; amino acids 4-30, 54-65, 91-105, 107-131, 135-154, 163-192, 199-208, 210-224, 229-239, 248-257, 263-279, 281-294, 328-354, 373-379, 382-405, 426-453, 462-487 and 249-323 of Seq ID No 245; amino acids 4-10, 12-24, 45-55, 75-88 and 24-40 of Seq ID No 246; amino acids 4-14, 20-37, 47-53, 55-61, 75-81, 97-103, 107-124, 129-135, 139-147, 160-166, 169-175, 181-190, 202-221, 247-255, 272-285, 300-310, 318-332, 351-361, 384-397, 406-427, 442-449, 458-482, 494-503, 512-524, 531-539, 552-562, 577-588, 590-596, 600-608, 613-624, 637-668, 692-700 and 232-278 of Seq ID No 247; amino acids 33-39, 49-55, 68-84, 90-96, 104-120, 126-143, 150-159, 168-191, 197-208, 219-225, 227-233, 241-247, 63-115 and 200-250 of Seq ID No 248; amino acids 4-22, 24-34, 36-55, 57-76, 83-97, 99-117, 135-143, 145-157, 163-174, 178-198, 200-207, 209-270, 276-290, 321-335, 338-347, 367-374, 393-402, 404-411, 416-422, 443-460, 467-473 and 117-183 of Seq ID No 249; amino acids 26-37, 44-52, 57-96, 104-111, 118-124, 155-177, 179-197, 201-214, 223-233, 243-250, 257-262, 291-297, 303-314, 319-363 and 47-105 of Seq ID No 250; amino acids 36-43, 45-60, 76-97, 107-125, 131-156, 158-164 and 118-163 of Seq ID No 251; amino acids 5-32, 40-50, 52-60, 70-88, 92-101, 106-126, 138-150, 152-161, 175-193, 201-234, 237-248, 270-285, 297-303, 312-318 and 209-255 of Seq ID No 252; amino acids 4-12, 23-34, 49-55, 59-65, 70-81, 83-130 and 62-113 of Seq ID No 253; amino acids 4-26, 38-49, 69-76, 82-96, 103-119, 126-140, 143-190, 194-209, 212-218 and 100-167 of Seq ID No 254; amino acids 7-29, 35-47, 56-66, 80-94, 97-123, 125-148, 150-160, 166-173, 175-191, 193-200, 207-225 and 75-176 of Seq ID No 255; amino acids 14-36, 39-45, 51-59, 66-71, 76-88, 106-117, 121-126, 140-157, 164-187, 198-206, 210-252 and 202-256 of Seq ID No 256; amino acids 4-19, 27-35, 90-107, 120-134, 144-150, 166-175, 192-198, 221-243, 249-255, 263-278, 283-288, 305-321, 324-334, 342-349, 355-366, 377-390, 413-425, 442-448 and 130-178 of Seq ID No 257; amino acids 17-26, 41-51, 54-61, 64-72, 78-105, 117-125, 127-137, 147-155, 175-213, 230-236, 238-261, 271-277, 282-297, 309-318, 329-347, 355-372, 377-390 and 69-126 of Seq ID No 258; amino acids 4-48, 54-60, 62-69, 73-81, 88-115, 124-137, 139-154, 156-169, 171-190, 194-231, 240-273, 288-303, 336-363, 367-395, 405-411, 434-442, 449-454, 466-483, 491-507 and 226-282 of Seq ID No 259; amino acids 26-34, 39-47, 50-80, 82-88, 97-105, 108-127, 131-137, 162-180, 185-191, 198-203, 209-214, 226-247, 256-288, 296-305 and 149-239 of Seq ID No 260; amino acids 5-28, 30-54, 73-84, 89-98, 109-116, 122-128, 137-142, 163-189, 207-236, 245-280, 288-390, 404-423, 426-433, 450-474, 487-504, 506-513, 524-530, 532-595, 605-614, 620-626, 631-638, 644-657, 667-683, 686-693, 695-702, 707-733, 739-747 and 6-62 of Seq ID No 261; amino acids 23-31, 39-50, 55-67, 76-100, 117-130, 149-171, 173-185, 218-238, 242-288, 291-298, 334-346, 355-369, 382-399, 413-420, 431-438, 442-449, 455-466, 486-493, 498-508, 524-531, 540-546, 551-558, 562-570, 575-582, 585-596, 598-604, 621-630, 632-650, 670-677, 682-701, 736-749, 755-761 and 612-626 of Seq ID No 262; amino acids 4-21, 24-39, 44-68, 74-81, 85-91, 109-116, 129-138, 142-148, 173-188, 195-201, 207-212, 223-228 and 126-148 of Seq ID No 263; amino acids 4-17, 24-42, 61-67, 84-93, 96-102, 116-121, 135-143, 155-165, 177-186, 210-224, 253-259, 272-297, 299-331, 337-351, 359-367, 369-385 and 1-49 of Seq ID No 264; amino acids 4-25, 28-54, 67-81, 85-136, 138-143, 157-170, 180-190, 197-203, 205-214, 219-243, 246-270, 277-283, 290-299, 305-311 and 127-182 of Seq ID No 265; amino acids 11-20, 25-33, 75-80, 85-91, 113-124, 143-155, 161-170, 172-184 and 128-176 of Seq ID No 266; amino acids 4-9, 16-26, 28-34, 55-80, 120-143, 150-156, 158-164, 167-178, 185-190, 192-213, 221-237, 242-255, 257-272, 281-290, 325-332 and 48-106 of Seq ID No 267; amino acids 13-48, 59-70, 78-88, 95-112, 129-151, 153-161, 163-182, 214-221, 235-245, 248-277, 281-291, 293-301, 303-311, 315-320, 323-346, 377-383, 390-398, 447-454, 474-487, 491-512, 531-544, 547-553, 582-590, 597-603, 605-611, 623-629 and 410-466 of Seq ID No 268; amino acids 6-26, 39-46, 48-58, 69-75, 109-121, 139-144, 148-155, 166-172, 215-221, 261-267, 313-319, 363-386, 423-433, 447-458, 465-471, 483-494, 497-517, 558-565, 578-586, 589-597, 619-626, 636-645, 659-665, 671-680, 682-693, 733-739 and 152-206 of Seq ID No 269; amino acids 4-19, 23-35, 40-50, 52-58, 65-73, 78-103, 112-125, 146-160, 163-192, 194-200 and 29-90 of Seq ID No 270; amino acids 4-13, 17-32, 40-50, 57-67, 76-81, 88-95, 107-119, 131-142, 144-157, 171-178, 185-193, 197-207, 212-227, 231-238, 248-253, 263-310 and 90-170 of Seq ID No 271; amino acids 9-28, 57-82, 84-93, 126-135, 143-166, 173-194, 196-201, 212-220, 228-254, 269-277, 289-298, 305-316, 320-327, 330-337, 350-359, 373-378, 386-392, 403-411, 421-428, 435-441, 443-458, 465-470 and 80-141 of Seq ID No 272; amino acids 11-48, 54-67, 69-75, 89-95, 101-122, 124-131, 134-157, 159-175, 202-208, 214-228, 258-270, 272-280, 287-295, 298-310, 331-338, 340-417, 427-500, 502-509, 534-552, 556-561, 564-577, 585-592, 594-608, 621-627, 632-641, 643-652, 671-681, 683-709, 712-743, 758-764, 776-783, 789-820, 835-851, 864-883, 885-910, 913-940, 948-953, 967-976, 994-1020 and 775-825 of Seq ID No 273; amino acids 14-24, 32-54, 58-63, 70-80, 93-100, 108-125, 127-135, 142-153, 155-160, 180-191, 201-208, 210-216, 222-235, 242-264, 267-273, 276-282, 284-308 and 10-59 of Seq ID No 274; amino acids 16-28, 44-68, 70-77, 83-90, 99-129, 131-137, 145-154, 161-175, 183-190, 196-203, 205-220, 238-245, 321-328, 330-338, 366-379, 383-397, 399-405, 412-418, 442-458, 471-483, 486-505, 536-544, 562-568, 583-602, 610-618, 629-635, 641-655, 672-682, 697-705, 714-729, 744-751, 755-762, 766-771, 783-807 and 555-621 of Seq ID No 275; amino acids 4-9, 20-34, 45-54, 60-77, 79-89, 91-100, 102-149, 162-170, 177-189, 193-208, 210-222, 238-244, 252-264, 267-276, 302-307 and 100-140 of Seq ID No 276; amino acids 11-27, 30-49, 56-62, 69-74, 76-85, 94-108, 116-125, 129-147, 153-161, 165-171, 177-208, 217-223, 225-231, 237-255, 260-284, 293-300 and 73-137 of Seq ID No 277; amino acids 4-38, 40-51, 84-97, 99-106, 109-115, 119-129, 131-145, 148-160, 180-186, 188-202, 230-243, 246-267, 274-288, 290-299, 302-312, 317-327, 332-344, 353-377, 381-388, 407-419, 423-437, 447-470, 474-482, 486-494, 501-523, 531-546, 551-556 and 727-740 of Seq ID No 278; amino acids 23-52, 62-76, 87-104, 109-115, 117-123, 129-139, 143-149, 152-170, 172-191, 199-205, 212-218, 220-240, 249-256, 263-275, 297-303, 308-342, 349-380, 382-394, 414-420, 430-441, 446-452, 460-475, 488-505, 514-531, 533-539, 546-568, 570-577, 579-588, 613-625, 632-670, 672-716, 718-745, 759-769, 785-798, 801-807 and 272-324 of Seq ID No 279; amino acids 4-34, 36-43, 56-73, 80-87, 101-134, 148-159, 161-170, 178-185, 195-206, 211-221, 223-248, 259-271, 276-295, 297-308 and 241-296 of Seq ID No 280; amino acids 5-31, 44-50, 64-74, 86-94, 132-147, 154-167, 196-203, 209-219, 253-260, 284-289, 300-312, 319-327, 335-340, 358-364, 376-383 and 166-202 of Seq ID No 281; amino acids 4-9, 12-27, 29-71, 77-84, 90-108, 114-142, 147-164, 180-213, 217-227, 229-282, 291-309, 322-329, 336-353, 365-370 and 317-364 of Seq ID No 282; amino acids 36-41, 52-66, 71-83, 89-95, 116-127, 154-174, 176-184, 200-206, 230-237, 248-259, 269-284, 307-316, 376-383, 399-418, 424-442, 445-451, 454-462 and 1-50 of Seq ID No 283; amino acids 9-14, 33-49, 64-72, 87-92, 103-109, 123-128, 130-141, 143-154, 160-166, 182-214, 237-247, 251-260, 292-300, 327-332, 337-350, 357-365, 388-398, 405-411, 422-428, 451-459, 478-488, 520-531, 534-540, 558-564, 580-586, 591-600, 605-615, 629-635, 641-653, 658-672, 212-244 and 533-611 of Seq ID No 284; amino acids 4-10, 17-27, 30-37, 44-62, 80-85, 94-114, 118-131, 134-141, 148-161, 171-212, 218-241, 248-261, 274-313, 325-336, 342-348, 359-373, 391-397, 424-431, 454-474, 489-495, 497-503, 505-515, 548-553, 560-580, 591-610 and 277-324 of Seq ID No 285; amino acids 7-16, 18-24, 30-47, 49-70, 83-99, 103-117, 126-141, 146-153, 159-165, 177-194, 198-221, 236-246, 255-262, 273-279, 283-296, 301-332, 338-411, 422-428, 434-440, 452-458, 463-469, 494-509, 511-517, 524-531, 548-554, 564-572 and 335-389 of Seq ID No 286; amino acids 9-15, 33-54, 56-80, 102-108 and 1-42 of Seq ID No 287; amino acids 15-36, 42-55, 58-68 and 54-77 of Seq ID No 288; amino acids 55-75, 89-96, 98-110 and 14-36 of Seq ID No 289; amino acids 8-14, 29-51, 73-101, 110-117 and 70-114 of Seq ID No 290; amino acids 20-25, 29-34, 41-52, 60-67, 69-85, 90-100, 114-122, 136-142, 160-170, 174-181 and 21-58 of Seq ID No 291; amino acids 14-22 and 4-13 of Seq ID No 292; amino acids 22-40, 54-66, 88-105, 109-118 and 31-74 of Seq ID No 293; amino acids 5-11, 18-32, 47-60, 66-73, 83-92, 113-120, 126-141, 151-164, 167-174, 201-211 and 118-129 of Seq ID No 294; amino acids 5-11, 18-24, 32-40, 47-53 and 25-54 of Seq ID No 295; amino acids 18-24, 31-48 and 5-55 of Seq ID No 296; amino acids 10-16, 26-32, 47-56, 85-95 and 10-62 of Seq ID No 297; amino acids 4-12, 16-26 and 25-34 of Seq ID No 298; amino acids 19-29, 45-51, 63-68, 76-92, 103-110, 114-120, 123-133, 135-141 and 14-78 of Seq ID No 299; amino acids 4-18, 47-61 and 57-93 of Seq ID No 300; amino acids 17-29, 44-50 and 26-38 of Seq ID No 301; amino acids 5-19, 55-64, 78-85, 95-101, 104-112 and 24-33 of Seq ID No 302; amino acids 4-10 and 12-31 of Seq ID No 303; amino acids 4-12, 27-41, 43-58, 60-67, 76-86 and 13-65 of Seq ID No 304; amino acids 30-38, 57-67 and 5-32 of Seq ID No 305; amino acids 30-43 and 2-21 of Seq ID No 306; amino acids 14-20, 23-36, 41-48 and 1-52 of Seq ID No 307; amino acids 18-33, 51-58, 76-82 and 32-46 of Seq ID No 308; amino acids 25-31 and 2-16 of Seq ID No 309; amino acids 14-23, 50-58 and 9-49 of Seq ID No 310; amino acids 4-10, 22-31, 35-45, 48-68, 71-80 and 17-66 of Seq ID No 311; amino acids 4-24, 28-42, 46-56, 63-69, 87-94, 112-131 and 2-46 of Seq ID No 312; amino acids 4-15, 19-28, 34-41, 52-62, 78-86 and 2-20 of Seq ID No 313; amino acids 4-11, 16-30, 32-42 and 7-38 of Seq ID No 314; amino acids 4-20, 22-31 and 22-38 of Seq ID No 315; amino acids 4-19 and 17-32 of Seq ID No 316; amino acids 7-13, 17-22, 27-33, 80-100 and 26-40 of Seq ID No 317; amino acids 10-18, 22-48 and 32-44 of Seq ID No 318; amino acids 15-24, 43-49, 73-83 and 45-93 of Seq ID No 319; amino acids 22-29, 46-55, 57-63 and 5-17 of Seq ID No 320; amino acids 10-33 and 21-35 of Seq ID No 321; amino acids 16-24 and 22-49 of Seq ID No 322; amino acids 4-16, 37-73, 76-110, 117-125, 127-132 and 2-30 of Seq ID No 323; amino acids 4-12, 23-35, 44-56, 59-88 and 22-76 of Seq ID No 324; amino acids 15-26 and 23-35 of Seq ID No 325; amino acids 12-22, 31-40 and 17-44 of Seq ID No 326; amino acids 4-9, 13-18, 29-35 and 57-64 of Seq ID No 327; amino acids 31-55, 67-81 and 25-70 of Seq ID No 328; amino acids 13-24, 51-58 and 13-26 of Seq ID No 329; amino acids 6-20, 29-40, 57-79 and 46-88 of Seq ID No 330; amino acids 8-14, 41-54, 68-76, 83-93, 106-126, 130-139 and 12-72 of Seq ID No 331; amino acids 5-13, 17-24, 41-55, 64-69, 80-85, 94-107, 109-115 and 53-88 of Seq ID No 332; amino acids 5-12, 32-54, 57-64 and 20-33 of Seq ID No 333; amino acids 4-16, 40-48, 50-58, 62-68, 75-85, 92-104, 108-116, 124-134 and 68-128 of Seq ID No 334; amino acids 7-13, 19-29, 34-40, 54-71, 76-81, 91-144, 147-155, 157-188 and 11-83 of Seq ID No 335; amino acids 17-24, 32-41 and 6-43 of Seq ID No 336; amino acids 14-31, 38-59, 69-87, 95-102, 126-146, 157-162, 177-193, 201-227, 238-251 and 63-78 of Seq ID No 337; amino acids 10-16, 18-25, 27-41, 43-52, 59-86, 94-101, 134-140 and 38-100 of Seq ID No 338; amino acids 4-19, 23-35, 43-72, 78-92 and 37-93 of Seq ID No 339; amino acids 15-20, 27-32, 41-65, 69-82, 93-105, 107-115, 120-147, 170-178, 184-201, 214-257, 272-281, 293-314, 332-339, 358-364, 374-381, 390-397, 399-414, 428-460 and 317-375 of Seq ID No 340; amino acids 11-28, 47-55, 59-68, 76-105, 108-116, 120-144, 146-160, 167-175, 180-187, 209-233 and 144-158 of Seq ID No 341; amino acids 4-13, 58-78 and 14-77 of Seq ID No 342; amino acids 26-31, 44-49, 57-64, 67-74, 107-112, 116-152, 154-181, 202-212, 241-255 and 57-101 of Seq ID No 343; amino acids 10-41, 53-70, 81-93, 100-111, 137-147, 164-169, 183-190, 199-210, 216-221, 226-240 and 84-95 of Seq ID No 344; amino acids 12-45, 48-56, 73-79, 91-103, 106-112, 117-125, 132-143, 154-160, 178-201, 208-214, 216-225, 260-266, 276-283 and 98-115 of Seq ID No 345; amino acids 4-15, 30-42 and 29-39 of Seq ID No 346; amino acids 22-53, 55-73, 80-88 and 33-66 of Seq ID No 347; amino acids 6-23, 44-54 and 56-67 of Seq ID No 348; amino acids 8-21, 35-44, 66-75, 82-87, 94-101 and 32-94 of Seq ID No 349; amino acids 8-20, 23-32, 36-50, 53-69 and 15-69 of Seq ID No 350; amino acids 8-22 of Seq ID No 351; amino acids 31-37 and 2-31 of Seq ID No 352; amino acids 4-20, 23-39, 58-63, 71-78, 97-102 and 22-82 of Seq ID No 353; amino acids 23-44, 135-152, 168-184 and 57-116 of Seq ID No 354; amino acids 24-31, 42-50, 52-62, 93-117 and 43-94 of Seq ID No 355; amino acids 20-29 and 24-43 of Seq ID No 356; amino acids 12-57, 59-74 and 22-40 of Seq ID No 357; amino acids 7-16, 18-26, 39-45, 68-78, 86-92 and 65-82 of Seq ID No 358; amino acids 5-17, 19-34, 42-48, 56-71, 102-113, 118-129 and 67-111 of Seq ID No 359; amino acids 4-33, 50-71 and 13-55 of Seq ID No 360; amino acids 9-17, 23-30, 37-54, 69-88, 96-102, 114-123, 130-140, 143-163 and 5-70 of Seq ID No 361; amino acids 4-23, 27-52, 71-80 and 9-94 of Seq ID No 362; amino acids 13-19 and 2-21 of Seq ID No 363; amino acids 18-26, 28-52, 63-74, 94-107, 123-134 and 18-84 of Seq ID No 364; amino acids 19-33, 57-68 and 26-48 of Seq ID No 365; amino acids 4-26, 31-37, 42-59 and 12-65 of Seq ID No 366; amino acids 4-25 and 20-39 of Seq ID No 367; amino acids 40-51, 54-62, 67-75, 83-89, 126-146, 148-156 and 31-42 of Seq ID No 368; amino acids 4-15, 23-33, 38-49, 82-98 and 7-91 of Seq ID No 369; amino acids 6-26, 36-57 and 40-64 of Seq ID No 370; amino acids 6-15, 21-28, 32-38, 57-65, 78-103, 114-134, 138-144, 154-163 and 41-95 of Seq ID No 371; amino acids 13-30, 47-57, 71-76 and 25-71 of Seq ID No 372; amino acids 4-31, 43-51, 55-63, 67-72, 76-83, 88-95, 99-118, 125-132, 134-159 and 82-118 of Seq ID No 373; amino acids 4-17, 26-32, 34-40, 45-61, 67-92 and 41-97 of Seq ID No 374; amino acids 179-208 and 198-227 of Seq ID No 204; amino acids 45-69, 65-89 and 83-106 of Seq ID No 205; amino acids 269-290 of Seq ID No 206; amino acids 209-230, 226-249 and 245-269 of Seq ID No 207; amino acids-9-15, 10-33 and 28-52 of Seq ID No 208; amino acids 29-50, 45-67 and 62-85 of Seq ID No 209; amino acids 96-120, 115-139 and 134-158 of Seq ID No 210; amino acids 519-543, 539-563 and 559-584 of Seq ID No 211; amino acids 10-35, 31-56 and 52-77 of Seq ID No 212; amino acids 382-407 and 403-428 of Seq ID No 213; amino acids 66-90 of Seq ID No 214; amino acids 38-65 and 61-88 of Seq ID No 215; amino acids 56-85, 198-221, 217-240 and 236-261 of Seq ID No 216; amino acids 108-132 and 128-153 of Seq ID No 217; amino acids 13-37, 33-56, 52-76, 175-200 and 196-220 of Seq ID No 218; amino acids 132-156, 152-176 and 172-195 of Seq ID No 219; amino acids 489-512, 508-531 and 526-549 of Seq ID No 220; amino acids 416-442, 438-465 and 461-489 of Seq ID No 221; amino acids 199-222, 217-240 and 235-257 of Seq ID No 222; amino acids 25-55, 51-81 and 77-107 of Seq ID No 223; amino acids 18-46 and 42-66 of Seq ID No 224; amino acids 575-601 and 597-623 of Seq ID No 225; amino acids 274-299, 295-320 and 316-339 of Seq ID No 226; amino acids 32-61 and 57-85 of Seq ID No 227; amino acids 266-291 and 287-313 of Seq ID No 228; amino acids 85-114 of Seq ID No 229; amino acids 36-64 and 83-109 of Seq ID No 230; amino acids 264-285 and 280-300 of Seq ID No 231; amino acids 102-128 and 124-152 of Seq ID No 232; amino acids 404-429 and 445-468 of Seq ID No 233; amino acids 343-374 and 370-401 of Seq ID No 234; amino acids 158-182 and 178-202 of Seq ID No 235; amino acids 151-180 of Seq ID No 236; amino acids 549-579, 575-605 and 601-630 of Seq ID No 237; amino acids-7-23 and 19-46 of Seq ID No 238; amino acids 48-75 and 71-98 of Seq ID No 239; amino acids 789-813 and 809-834 of Seq ID No 240; amino acids 759-783 of Seq ID No 241; amino acids 160-188, 184-211 and 207-232 of Seq ID No 242; amino acids 130-159 of Seq ID No 243; amino acids 117-147, 143-173 and 169-201 of Seq ID No 244; amino acids 248-276, 272-300 and 296-323 of Seq ID No 245; amino acids 21-43 of Seq ID No 246; amino acids 231-256 and 252-278 of Seq ID No 247; amino acids 62-91, 87-115 and 199-227 of Seq ID No 248; amino acids 116-141, 137-162 and 158-183 of Seq ID No 249; amino acids 46-69, 65-87 and 82-105 of Seq ID No 250; amino acids 117-142 and 138-163 of Seq ID No 251; amino acids 208-233 and 229-255 of Seq ID No 252; amino acids 61-88 of Seq ID No 253; amino acids 99-124, 120-145 and 141-167 of Seq ID No 254; amino acids 74-103, 99-128, 124-152 and 148-176 of Seq ID No 255; amino acids 202-231 and 227-256 of Seq ID No 256; amino acids 129-154 and 150-178 of Seq ID No 257; amino acids 95-126 of Seq ID No 258; amino acids 226-256 and 252-282 of Seq ID No 259; amino acids 171-198, 194-221 and 217-240 of Seq ID No 260; amino acids 35-65 and 61-91 of Seq ID No 261; amino acids 608-631 of Seq ID No 262; amino acids 124-149 of Seq ID No 263; amino acids-14-21 and 17-49 of Seq ID No 264; amino acids 127-157 and 153-182 of Seq ID No 265; amino acids 150-176 of Seq ID No 266; amino acids 48-79 and 75-106 of Seq ID No 267; amino acids 435-466 of Seq ID No 268; amino acids 151-180 and 176-206 of Seq ID No 269; amino acids 126-151 and 167-190 of Seq ID No 270; amino acids 89-118, 114-144 and 140-170 of Seq ID No 271; amino acids 80-112 of Seq ID No 272; amino acids 9-36 of Seq ID No 274; amino acids 117-140 of Seq ID No 276; amino acids 72-97, 93-117 and 113-137 of Seq ID No 277; amino acids 723-746 of Seq ID No 278; amino acids 271-300 of Seq ID No 279; amino acids 240-271 and 267-296 of Seq ID No 280; amino acids 165-188 and 183-206 of Seq ID No 281; amino acids 316-344 and 340-364 of Seq ID No 282; amino acids-3-27 and 23-50 of Seq ID No 283; amino acids 212-244, 532-561, 557-586 and 582-611 of Seq ID No 284; amino acids 276-302 and 298-324 of Seq ID No 285; amino acids 335-364 and 360-389 of Seq ID No 286; amino acids 41-64 and 59-82 of Seq ID No 287; amino acids 53-77 of Seq ID No 288; amino acids 13-37 of Seq ID No 289; amino acids 69-94 and 90-114 of Seq ID No 290; amino acids 19-42 and 37-60 of Seq ID No 291; amino acids 1-25 of Seq ID No 292; amino acids 30-54 and 50-75 of Seq ID No 293; amino acids 111-135 of Seq ID No 294; amino acids 25-54 of Seq ID No 295; amino acids 67-98 and 94-126 of Seq ID No 334; amino acids 9-32, 27-51, 46-70 and 65-86 of Seq ID No 335; amino acids 1-24 and 20-44 of Seq ID No 336; amino acids 58-82 of Seq ID No 337; amino acids 37-62, 58-82 and 77-101 of Seq ID No 338; amino acids 37-68 and 64-93 of Seq ID No 339; amino acids 317-347 and 343-375 of Seq ID No 340; amino acids 140-164 of Seq ID No 341; amino acids 13-40, 36-60 and 55-79 of Seq ID No 342; amino acids 56-79 and 75-101 of Seq ID No 343; amino acids 77-101 of Seq ID No 344; amino acids 94-118 of Seq ID No 345; amino acids 46-105 of Seq ID No 205; amino acids 56-111 of Seq ID No 216; amino acids 25-107 of Seq ID No 223; amino acids 19-66 of Seq ID No 224; amino acids 85-114 of Seq ID No 229; amino acids 37-109 of Seq ID No 230; amino acids 266-296 of Seq ID No 231; amino acids 103-152 of Seq ID No 232; amino acids 167-218 of Seq ID No 235; amino acids 790-834 of Seq ID No 240; amino acids 761-781 of Seq ID No 241; amino acids 176-232 of Seq ID No 242; amino acids 117-201 of Seq ID No 244; amino acids 249-323 of Seq ID No 245; amino acids 232-278 of Seq ID No 247; amino acids 209-255 of Seq ID No 252; amino acids 75-176 of Seq ID No 255; amino acids 202-256 of Seq ID No 256; amino acids 130-178 of Seq ID No 257; amino acids 69-126 of Seq ID No 258; amino acids 126-148 of Seq ID No 263; amino acids 1-49 of Seq ID No 264; amino acids 127-182 of Seq ID No 265; amino acids 48-106 of Seq ID No 267; amino acids 410-466 of Seq ID No 268; amino acids 152-206 of Seq ID No 269; amino acids 555-621 of Seq ID No 275; amino acids 166-202 of Seq ID No 281; amino acids 317-364 of Seq ID No 282; amino acids 1-50 of Seq ID No 283; amino acids 277-324 of Seq ID No 285; amino acids 14-36 of Seq ID No 289; amino acids 6-43 of Seq ID No 336; amino acids 57-101 of Seq ID No 343; amino acids 84-95 of Seq ID No 344; amino acids 98-115 of Seq ID No 345.

In one embodiment the antigen further consists of
a) 1 to 50 additional amino acid residue(s), preferably 1 to 40, more preferably 1 to 30, even more preferably at most 1 to 25, still more preferably at most 1 to 10, most preferably 1, 2, 3, 4 or 5 additional amino acid residue(s); and/or
b) at least one amino acid residue heterologous to the core amino acid sequence.

Said additional amino acid residue(s) are further defined above.

In another embodiment said amino acid residue(s) is/are flanking the core amino acid sequence N-terminally, C-terminally, or N- and C-terminally.

In an embodiment of the invention the antigen comprises at least 2, at least 3, at least 4, at least 5 or at least 6 core amino acid sequences as defined above.

The problem underlying the present invention is solved in another aspect by a process for producing an antigen, or an active fragment or an active variant thereof, as defined in the present invention, comprising expressing the nucleic acid molecule as defined above.

The present invention further relates to a process for producing a cell which expresses an antigen, or an active fragment or an active variant thereof, as defined above, comprising transforming or transfecting a suitable host cell with the vector as defined above.

In an embodiment, the antigen, or the active fragment or the active variant thereof, is isolated from *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The problem underlying the present invention is solved in another aspect by a pharmaceutical composition, preferably a vaccine, comprising an antigen, or an active fragment or an active variant thereof, as defined above, or a nucleic acid molecule as defined above or a vector as defined above.

Another aspect of the present invention provides a pharmaceutical composition, preferably a vaccine, comprising an antigen, or an active fragment or an active variant thereof, as defined above, or a nucleic acid molecule as defined above or a vector as defined above for the treatment or prevention of an infection with *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

In a preferred embodiment the pharmaceutical composition of the present invention further comprises an immunostimulatory substance, preferably selected from the group comprising polycationic polymers, especially polycationic peptides, immunostimulatory oligo-deoxynucleotides (ODNs), especially Oligo(dIdC)$_{13}$, peptides containing at least two LysLeuLys motifs, especially KLKLLLLLKLK (SEQ ID NO: 766), neuroactive compounds, especially human growth hormone, alum, Freund's complete or incomplete adjuvants, or combinations thereof.

In a more preferred embodiment of the pharmaceutical composition of the present invention the immunostimulatory substance is a combination of either a polycationic polymer and immunostimulatory deoxynucleotides or of a peptide containing at least two LysLeuLys motifs and immunostimulatory deoxynucleotides, preferably a combination of KLKLLLLLKLK (SEQ ID NO: 766) and Oligo(dIdC)$_{13}$.

In a still more preferred embodiment of the pharmaceutical composition of the present invention the polycationic polymer is a polycationic peptide, especially polyarginine.

Still another aspect of the present invention provides an antigen, or an active fragment or an active variant thereof, as defined above, or a nucleic acid molecule as defined above or a vector as defined above for the treatment or prevention of an infection with *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

Another preferred embodiment of the invention relates to the use of a nucleic acid molecule as defined above, or an antigen, an active fragment or an active variant thereof, as defined above, for the preparation of a pharmaceutical composition, especially for the preparation of a vaccine, for treating or preventing infections with *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The problem underlying the present invention is solved in a further aspect by an antibody, or at least an effective part thereof, which binds to at least a selective part of an antigen, or a fragment thereof, preferably an active fragment thereof, or a variant thereof, preferably an active variant thereof, as defined above.

In a preferred embodiment the antibody is a monoclonal antibody.

In another preferred embodiment said effective part comprises a Fab fragment, a F(ab) fragment, a F(ab) N fragment, a F (ab)$_2$ fragment or a F$_v$ fragment.

In still another embodiment of the invention the antibody is a chimeric antibody.

In yet another embodiment the antibody is a humanized antibody.

Another aspect of the invention relates to a hybridoma cell line, which produces an antibody as defined above.

The problem underlying the present invention is furthermore solved by a method for producing an antibody as defined above, characterized by the following steps:
a) initiating an immune response in a non-human animal by administrating an antigen, or an active fragment or an active variant thereof, as defined above, to said animal,
b) removing an antibody containing body fluid from said animal, and
c) producing the antibody by subjecting said antibody containing body fluid to further purification steps.

The invention further relates to a method for producing an antibody as defined above, characterized by the following steps:
a) initiating an immune response in a non-human animal by administrating an antigen, or an active fragment or an active variant thereof, as defined above, to said animal,
b) removing the spleen or spleen cells from said animal,
c) producing hybridoma cells of said spleen or spleen cells,
d) selecting and cloning hybridoma cells specific for said antigen, or for said active fragment or for said active variant thereof,
e) producing the antibody by cultivation of said cloned hybridoma cells, and
f) optionally conducting further purification steps.

Another aspect of the present invention is related to a pharmaceutical composition comprising an antibody as specified above.

Still another aspect relates to an antibody as defined above or a pharmaceutical composition comprising an antibody as defined above for the treatment or prevention of an infection with *Klebsiella*, preferably *K. pneumoniae* including the three subspecies *pneumoniae*, *ozaenae* and *rhinoscleromatis*, *K. oxytoca*, *K. planticola*, *K. terrigena*, and *K. ornithinolytica*, and more preferably from *K. pneumoniae* or *K. oxytoca*.

The problem underlying the present invention is solved in another aspect by the use of an antibody as defined above for the preparation of a pharmaceutical composition for treating or preventing infections with *Klebsiella*, preferably *K. pneumoniae* including the three subspecies *pneumoniae*, *ozaenae* and *rhinoscleromatis*, *K. oxytoca*, *K. planticola*, *K. terrigena*, and *K. ornithinolytica*, and more preferably from *K. pneumoniae* or *K. oxytoca*.

According to another aspect the present invention provides an antagonist, which binds or is capable of binding to an antigen, or an active fragment or active variant thereof as disclosed in the present invention. According to a still further aspect the antagonist according to the present invention is an antagonist which is capable of reducing or inhibiting the interaction activity of an antigen, or an active fragment thereof or an active variant thereof, according to the present invention to its interaction partner. Such interaction partner is, in a preferred embodiment, an antibody or a receptor, preferably a physiological receptor, of said antigen, or an active fragment thereof or an active variant thereof.

According to another aspect the present invention provides a method for identifying an antagonist capable of binding to an antigen, or an active fragment or an active variant thereof, as defined above, comprising:
 a) contacting an isolated or immobilized antigen, or an active fragment or an active variant thereof, as defined above, with a candidate antagonist under conditions to permit binding of said candidate antagonist to said antigen, or an active fragment or active variant thereof, in the presence of a component capable of providing a detectable signal in response to the binding of the candidate antagonist to said antigen, or an active fragment or an active variant thereof; and
 b) detecting the presence or absence of a signal generated in response to the binding of the antagonist to said antigen, or an active fragment or active variant thereof.

The problem underlying the present invention is further solved by a method for identifying an antagonist capable of reducing or inhibiting the interaction activity of an antigen, or an active fragment or an active variant thereof, as defined above, to its interaction partner comprising:
 a) providing an antigen, or an active fragment or active variant thereof, as defined above,
 b) providing an interaction partner to said antigen, or said active fragment or active variant thereof, especially an antibody as defined above,
 c) allowing interaction of said antigen, or said active fragment or active variant thereof, to said interaction partner to form an interaction complex,
 d) providing a candidate antagonist,
 e) allowing a competition reaction to occur between the candidate antagonist and the interaction complex,
 f) determining whether the candidate antagonist inhibits or reduces the interaction activities of the antigen, or the active fragment or the active variant thereof, with the interaction partner.

The present invention further relates to the use of any of the antigens, or an active fragment or an active variant thereof, as defined above, for the isolation and/or purification and/or identification of an interaction partner of said antigen, or said active fragment or active variant thereof.

Another aspect of the present invention relates to a method for diagnosing an infection with a *Klebsiella* organism comprising the steps of:
 a) contacting a sample obtained from a subject with an antigen, or an active fragment or active variant thereof, as defined above; and
 b) detecting the presence of an antibody against said *Klebsiella* organism in the sample.

In yet another aspect the present invention provides a method for diagnosing an infection with a *Klebsiella* organism comprising the steps of:
 a) contacting a sample obtained from a subject with the antibody as defined above; and
 b) detecting the presence of an antigen of said *Klebsiella* organism in the sample.

In an embodiment of said method the antigen of said *Klebsiella* organism is an antigen, or an active fragment or an active variant thereof, as defined above.

Still another aspect relates to a method for diagnosing an infection with a *Klebsiella* organism comprising the steps of:
 a) contacting a sample obtained from a subject with a primer or a probe specific for a nucleic acid molecule, or a fragment thereof, as defined above; and
 b) detecting the presence of such nucleic acid molecule or fragment thereof in the sample.

The present invention also provides a process for in vitro diagnosing a disease related to expression of an antigen or a fragment thereof according to the present invention comprising determining the presence of a nucleic acid sequence encoding said antigen or fragment thereof according to the present invention or determining the presence of the antigen or fragment thereof according to the present invention.

In an embodiment of any of the above described methods for diagnosing an infection with a *Klebsiella* organism the *Klebsiella* organism is a pathogenic *Klebsiella* organism, more preferably a *Klebsiella* organism selected from the group comprising *K. pneumoniae* including the three subspecies *pneumoniae*, *ozaenae* and *rhinoscleromatis*, *K. oxytoca*, *K. planticola*, *K. terrigena*, and *K. ornithinolytica*, and more preferably from *K. pneumoniae* or *K. oxytoca*.

Moreover, the present invention provides the use of an antigen, or a fragment or a variant thereof, as defined in the present invention for the generation of a peptide binding to said antigen, or a fragment thereof or a variant thereof, wherein the peptide is an anticaline.

Moreover, the present invention provides the use of an antigen, or an active fragment or active variant thereof, as defined above, for the preparation of a functional nucleic acid, wherein the functional nucleic acid is selected from the group comprising aptamers and spiegelmers.

In another aspect, the present invention provides the use of a nucleic acid molecule as defined above for the preparation of a functional ribonucleic acid, wherein the functional ribonucleic acid is selected from the group comprising ribozymes, antisense nucleic acids and siRNA.

The problem underlying the present invention is further solved by a method for the treatment of a *Klebsiella* infection in an animal or human preferably in need thereof, comprising the step of administering to said animal or human a therapeutically effective amount of an antigen, or an active fragment or an active variant thereof, or a nucleic acid molecule, or a vector, or an antibody or a pharmaceutical composition as defined in any of the preceding aspects.

In an embodiment said *Klebsiella* infection is an infection with *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The problem underlying the present invention is solved in another aspect by a method for immunizing an animal or human against infection with a *Klebsiella* organism, comprising the step of administering to said animal or human an effective amount of the antigen, or an active fragment or an active variant thereof, as defined above, or the nucleic acid molecule as defined above, or a vector as defined above, or an antibody as defined above, or a pharmaceutical composition as defined above, wherein the effective amount is suitable to elicit an immune response in said animal or human.

In an embodiment of said method for immunizing an animal or human against infection with a *Klebsiella* organism the *Klebsiella* organism is selected from the group comprising *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The problem underlying the present invention is solved in yet another aspect by a method for stimulating an immune response in an animal or human against a *Klebsiella* organism, comprising the step of administering to said animal or human an effective amount of the antigen, or an active fragment or an active variant thereof, as defined above, or the nucleic acid molecule as defined above or a vector as defined above, or an antibody as defined above, or a pharmaceutical composition as defined above, wherein the effective amount is suitable to stimulate the immune response in said animal or human.

In an embodiment of said method for stimulating an immune response in an animal or human against a *Klebsiella* organism the *Klebsiella* organism is selected from the group comprising *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

It is within the present invention that the various methods and uses, respectively, where an antigen as defined in the present invention is used, can also be performed or practiced using a fragment of such antigen, preferably an active fragment thereof, or a variant of such antigen, preferably an active variant thereof, each as preferably described herein. It is also within the present invention that the various kinds of compounds disclosed herein as interacting with or targeting the antigen according to the present invention, can additionally or alternatively interact with or target the active fragment or the active variant of said antigen.

It is also within the present invention that each and any method in the practice of which an antibody is used, can, in principle, also be practiced when instead of the antibody the anticalines or the functional nucleic acids as defined herein are used, whereby it is preferred that such functional nucleic acid is selected from the group comprising aptamers and spiegelmers. This applies equally to the various uses of the present application.

In a preferred embodiment a fragment of an antigen as disclosed herein is a part of such antigen which exhibits at least one feature of such antigen. Preferably such feature is a feature selected from the group comprising suitability for the treatment of infections, immunization of an animal including human, and/or stimulation of an immune response in an animal including human.

It is also within the present invention that any disclosure made herein in relation to *Klebsiella* and more specifically *K. pneumoniae* is equally applicable to any *Klebsiellae* or *Klebsiella* species, whereby the *Klebsiella* species is preferably selected from the group comprising *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The terms "polypeptide", "peptide", "protein" or "antigen" are used interchangeably throughout the present specification and refer in a comprehensive manner to the antigen according to the present invention, including each and any variant, fragment, analogue or derivative thereof, particularly as described herein. Insofar, whenever the term polypeptide, peptide, protein or antigen is used herein, and if not explicitly stated otherwise, the respective disclosure is also made for or in relation to any antigen according to the present invention, including each and any variant, fragment, analogue or derivative thereof, particularly as described herein. Also it is to be understood that any use or aspect described in connection with any of the above mentioned compounds covered by the term polypeptide, peptide, protein or antigen according to the present invention shall be applicable also to each and any other of the above mentioned compounds covered by the term polypeptide, peptide, protein or antigen according to the present invention.

The present invention advantageously provides an efficient, relevant and comprehensive set of isolated nucleic acid molecules and antigens encoded by them, including the active fragments and the active variants thereof, using an antibody preparation from multiple human plasma pools and surface expression libraries derived from the genome of *K. pneumoniae*. Thus, the present invention fulfils a widely felt demand for *K. pneumoniae* antigens, vaccines, diagnostics and products useful in procedures for preparing antibodies and for identifying compounds effective against infections caused by pathogenic *Klebsiellae*, more preferably *K. pneumoniae* including the three subspecies *pneumoniae, ozaenae* and *rhinoscleromatis, K. oxytoca, K. planticola, K. terrigena*, and *K. ornithinolytica*, and most preferably from *K. pneumoniae* or *K. oxytoca*.

An effective vaccine should be composed of proteins or polypeptides, which are expressed by all strains and are able to induce high affinity, abundant antibodies against cell surface components of said pathogenic *Klebsiellae*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. The antibodies should be IgG1 and/or IgG3 for opsonization, and any IgG subtype for neutralisation of adherence and toxin action. A chemically defined vaccine must be definitely superior compared to a whole cell vaccine (attenuated or killed), since components of said pathogenic *Klebsiellae*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*, which cross-react with human tissues or inhibit opsonization can be eliminated, and the individual polypeptides inducing protective antibodies and/or a protective immune response can be selected.

In a preferred embodiment of the present invention, the nucleic acid molecules exhibit 70% identity over their entire length to a nucleotide sequence set forth in Seq ID Nos 1 to 187 and Seq ID No 375. More preferred are nucleic acids that comprise a region that is at least 80% or at least 85% identical over their entire length to a nucleic acid molecule set forth in Seq ID Nos 1 to 187 and Seq ID No 375. In this regard, nucleic acid molecules, which are at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic acids, which encode antigens or fragments thereof (polypeptides), which retain substantially the same biological function or activity as the mature polypeptide set forth in the Seq ID Nos 188 to 374 and Seq ID No 376. It is also within the present invention that the nucleic acid molecules according to the present invention are coding for a protein which is preferably an antigen. Still further it is within the present invention, that the molecules defined by Seq ID Nos 188 to 374 and Seq ID No 376 are proteins, which are preferably antigens.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While there exist a number of methods to measure identity between two polynucleotide or two polypeptide sequences, the term is well known to skilled artisans (e.g. *Sequence Analysis in Molecular Biology*, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package (Devereux, J. et al., 1984), BLASTP, BLASTN, and FASTA (Altschul, S. et al., 1990).

As a second alternative to the nucleic acid molecules described herein by reference to Seq ID Nos 1-187 and Seq ID No 375, the description of which is also referred to herein as first alternative, the nucleic acid molecules according to the present invention can also be nucleic acid molecules, which are at least essentially complementary to the nucleic acids described in accordance with the first alternative herein. It will be acknowledged by the ones skilled in the art that an individual nucleic acid molecule is at least essentially complementary to another individual nucleic acid molecule. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably 80%, even more preferably 90% and most preferably any percentage higher than 90%. Such higher percentage includes 91, 92, 93, 94, 95, 96, 97, 98, 99 and 100%, whereby such definition is applicable to each aspect of the present application where this kind of terminology is used. It is to be noted that a percentage of 70% matching bases is considered as homology and the hybridisation having this extent of matching base pairs is considered as stringent. Hybridisation conditions for this kind of stringent hybridisation may be taken from Current Protocols in Molecular Biology (John Wiley and Sons, Inc., 1987). More particularly, the hybridisation conditions can be as follows:

Hybridisation performed e.g. in 5×SSPE, 5×Denhardt's reagent, 0.1% SDS, 100 g/mL sheared DNA at 68° C.
Moderate stringency wash in 0.2×SSC, 0.1% SDS at 42° C.
High stringency wash in 0.1×SSC, 0.1% SDS at 68° C.

Genomic DNA with a GC content of 50% has an approximate $T_M$ of 96° C. For 1% mismatch, the $T_M$ is reduced by approximately 1° C.

In addition, any of the further hybridisation conditions described herein are in principle applicable as well.

Of course, all nucleic acid sequence molecules which encode the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for active fragments or active variants of a given antigen, as long as the fragments or variants encode an antigen being suitable to be used such that the same effect can be obtained as if the full-length antigen was used. Preferably, such antigens or active fragments or active variants thereof may be used in a vaccination application, e.g. as an active or passive vaccine.

As a third alternative, the nucleic acid molecule according to the present invention can also be a nucleic acid which comprises a stretch of at least 15 bases of the nucleic acid molecule according to the first or second alternative of the nucleic acid molecules according to the present invention as outlined above. Preferably, the bases form a contiguous stretch of bases. However, it is also within the scope of the present invention that the stretch consists of two or more moieties, which are separated by a number of bases.

The nucleic acid molecules according to the present invention may preferably consist of at least 20, even more preferred at least 30, especially at least 50 contiguous bases from the sequences disclosed herein. The suitable length may easily be optimised due to the intended field of use (e.g. as (PCR) primers, probes, capture molecules (e.g. on a (DNA) chip), etc.). Preferred nucleic acid molecules contain at least a contiguous 15 base portion of one or more of the immunogenic amino acid sequences listed in Tables 1 and 4. Specifically preferred are nucleic acids containing a contiguous portion of a DNA sequence of any sequence contained in the sequence protocol of the present application which shows 1 or more, preferably more than 2, especially more than 5, non-identical nucleic acid residues compared to the unfinished genome sequences of *K. pneumoniae* MGH78578 and Kp342 that are available at the National Center for Biotechnology Information, U.S. National Library of Medicine, 8600 Rockville Pike, Bethesda MD, 20894 USA, or the German Research Center for Environmental Health and the J. Craig Venter Institute, 9704 Medical Center Drive, Rockville, Md, 20850 and plasmids as specified in the following by their accession numbers *K. pneumoniae* plasmid pJHCMW1, NC_003486, *K. pneumoniae* plasmid pIP843, NC_005015, *K. pneumoniae* plasmid pK2044, NC_006625, *K. pneumoniae* plasmid pKlebBk17-80, NC_002610, *K. pneumoniae* plasmid pKPN2, NC_005018, *K. pneumoniae* plasmid pLVPK, NC_005249, *Klebsiella* sp. KCL-2 plasmid pMGD2, NC_003789. However, the unfinished genome sequences mentioned above are subject to continuous resequencing, corrections, amendments and additions. For example, as of April 2007 the sequence available at the J. Craig Venter Institute, 9704 Medical Center Drive, Rockville, Md, 20850 is in status 7 out of 9 status codes, which means that additional sequences generated for gap closure have been assembled and added to data release. Specifically preferred non-identical nucleic acid residues are residues, which lead to a non-identical amino acid residue. Preferably, the nucleic acid sequences encode polypeptides, proteins, or antigens having at least 1, preferably at least 2, preferably at least 3 different amino acid residues compared to the published or listed *K. pneumoniae* counterparts mentioned above. Preferably, this kind of polypeptides, proteins, or antigens still has at least one of the characteristics of the molecules disclosed herein having identical amino acid residues. Also preferred are such isolated polypeptides, which are fragments of the proteins or of the antigens disclosed herein, e.g. in the Sequence Listing, having at least 6, 7, or 8 amino acid residues and being encoded by the nucleic acids as described herein.

The nucleic acid molecule according to the present invention can, as a fourth alternative, also be a nucleic acid molecule which anneals under stringent hybridisation conditions to any of the nucleic acids of the present invention according to the first, second, or third alternative as disclosed herein. Stringent hybridisation conditions are typically those described herein.

Finally, the nucleic acid molecule according to the present invention can, as a fifth alternative, also be a nucleic acid molecule which, but for the degeneracy of the genetic code, would hybridise to any of the nucleic acid molecules of the present invention according to the first, second, third, and fourth alternative as outlined herein. This kind of nucleic acid molecule refers to the fact that preferably the nucleic acids according to the present invention code for the antigen, or fragments or variants thereof, according to the present invention. This kind of nucleic acid molecule is particularly useful in the detection of a nucleic acid molecule according to the present invention and thus the diagnosis of the respective microorganisms such as *K. pneumoniae* or any pathogenic *Klebsiellae*, particularly those pathogenic *Klebsiella* species disclosed herein, and any disease or diseased condition where these kinds of microorganism are involved. Preferably, such microorganism, especially an opportunistic microorganism, is causing such disease directly or indirectly. Preferably, the hybridisation could occur or be preformed under stringent conditions as described in connection with the fourth alternative described herein.

Nucleic acid molecule as used herein generally refers to any ribonucleic acid molecule or deoxyribonucleic acid molecule, which may be unmodified RNA or DNA or modified RNA or DNA. Thus, for instance, nucleic acid molecule as used herein refers to, among others, single- and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may be derived from one or more of the molecules, but more typically involve only a region of some of the molecules. One of the molecules of a triple-helical region often is an oligonucleotide. As used herein, the term nucleic acid molecule includes DNAs or RNAs as described above that contain one or more modified bases. Thus, DNAs or RNAs with backbones modified for stability or for other reasons are "nucleic acid molecule" as that term is intended herein. Moreover, DNAs or RNAs comprising unusual bases, such as inosine, or modified bases, such as tritylated bases, to name just two examples, are nucleic acid molecule as the term is used herein. It will be appreciated that a great variety of modifications can be made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the present application, more specifically of the *K. pneumoniae* coding regions, which can be generated by standard cloning methods. To be unique, a fragment must be of sufficient size to distinguish it from other known nucleic acid sequences, most readily determined by comparing any selected *K. pneumoniae* fragment to the nucleotide sequences in biosequence databases such as GenBank. It will be appreciated by the one skilled in the art that what is said herein in any aspect in relation to *K. pneumoniae* applies equally to any of the other *Klebsiella* species described herein, more preferably any pathogenic *Klebsiella* species described herein.

Additionally, modifications can be made to the nucleic acid molecules and polypeptides that are encompassed by the present invention. For example, the nucleic acid also includes sequences that are a result of the degeneration of the genetic code. There are 20 natural amino acids, most of which are specified by more than one codon. Thus, nucleotide substitutions can be made which do not affect the polypeptide encoded by the nucleic acid. Accordingly, any nucleic acid molecule which encodes an antigen or fragments thereof is encompassed by the present invention.

Furthermore, any of the nucleic acid molecules encoding antigens or fragments thereof provided by the present invention can be functionally linked, using standard techniques such as standard cloning techniques, to any desired regulatory sequences, whether an *K. pneumoniae* regulatory sequence or a heterologous regulatory sequence, heterologous leader sequence, heterologous marker sequence or a heterologous coding sequence to create a fusion protein.

Nucleic acid molecules of the present invention may be in the form of RNA, such as mRNA or cRNA, or in the form of DNA, including, for instance, cDNA and genomic DNA obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand.

The present invention further relates to variants of the nucleic acid molecules described herein which encode fragments, analogs and derivatives of the antigens and fragments thereof having a deducted *K. pneumoniae* amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have an *K. pneumoniae* sequence as set forth in the Sequence Listing, in which several, a few, 5 to 10, 1 to 5, 1 to 3, 2, 1 or no amino acid(s) is substituted, deleted or added, in any combination. Especially preferred among these are silent substitutions, additions and deletions, which do not alter the properties and activities of the *K. pneumoniae* polypeptides set forth in the Sequence Listing. Also especially preferred in this regard are conservative substitutions.

The nucleic acid molecules of the present invention may also be used as a hybridisation probe for, e.g., RNA, cDNA and genomic DNA to isolate full-length cDNAs and genomic clones encoding polypeptides of the present invention and to isolate cDNA and genomic clones of other genes that have a high sequence similarity to the nucleic acid molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labelled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for the development or preparation of pharmaceutical compositions and/or diagnostics for diseases, particularly human disease, as further discussed herein.

The nucleic acid molecules of the present invention that are oligonucleotides can be used in the processes herein as described, but preferably for PCR, to determine whether or not the *K. pneumoniae* genes identified herein in whole or in part are present and/or transcribed in infected tissue such as skin, synovia or blood. It is recognized that such sequences will also have utility in diagnosis of the stage of infection and type of infection the pathogen has attained. For this and other purposes arrays which are known as such in the art, comprising at least one of the nucleic acids or polypeptides according to the present invention as described herein, may be used.

The nucleic acid molecules according to the present invention may be used for the detection of nucleic acid molecules and organisms or samples containing these nucleic acids. Preferably such detection is for diagnosis, more preferably for the diagnosis of a disease related or linked to the presence or abundance of *Klebsiellae* or any other pathogen species of *Klebsiella*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

Eukaryotes (herein also "individual(s)"), particularly mammals, and especially humans, infected with *Klebsiellae* or any other pathogen species of *Klebsiella*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca* can be identified by detecting any of the nucleic acid molecules according to the present invention detected at the DNA level by a variety of techniques. Preferred nucleic acid molecule candidates for distinguishing *Klebsiellae* or said other pathogenic *Klebsiella* from other organisms can be obtained.

The invention provides a process for diagnosing disease, arising from infection with *Klebsiellae* or any other pathogen species of *Klebsiella*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*, comprising determining from a sample isolated or derived from an individual an increased level of expression of a nucleic acid molecule having the sequence of a nucleic acid molecule as disclosed herein and more preferably set forth in the Sequence Listing. Expression of nucleic acid molecules can be measured using any one of the methods well known in the art for the quantification of nucleic acid molecules, such as, for example, PCR, RT-PCR, RNase protection, Northern blotting, other hybridisation methods and the arrays described herein.

Isolated as used herein means separated "by the hand of man" from its natural state; i.e., that, if it occurs in nature, it has been changed or removed from its original environment, or both. For example, a naturally occurring nucleic acid molecule or a polypeptide naturally present in a living organism in its natural state is not "isolated", but the same nucleic acid molecule or polypeptide separated from the coexisting materials of its natural state is "isolated", as the term is employed herein. As part of or following isolation, such nucleic acid molecules can be joined to other nucleic acid molecules, such as DNAs, for mutagenesis, to form fusion proteins, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acid molecules of the present invention may be originally formed in vitro, e.g. by chemical synthesis, or in a cell culture and subsequent isolation or purification. In general, the nucleic acids may be obtained by the manipulation of nucleic acids by endonucleases and/or exonucleases and/or polymerases and/or ligases and/or recombinases or other methods known to the skilled practitioner to produce the nucleic acids.

The nucleic acid sequences as defined by Seq ID Nos 1 to 187 and Seq ID No 375 start with the first complete codon comprised by the fragment as inserted into the vector and encodes the first amino acid as defined by Seq ID Nos 188 to 374 and Seq ID No 376. However, for the recombinant production additional nucleic acids might be useful or necessary to facilitate the cloning and expression.

Preferably, the nucleic acids can be isolated from *Klebsiellae* or any other pathogen species of *Klebsiella*, especially *K. pneumoniae* including the three subspecies *pneumoniae*, *ozaenae* and *rhinoscleromatis*, *K. oxytoca*, *K. planticola*, *K. terrigena*, and *K. ornithinolytica*, and more preferably from *K. pneumoniae* or *K. oxytoca* by methods known to the one skilled in the art. The same applies to the polypeptides according to the present invention.

The present invention also relates to vectors, which comprise a nucleic acid molecule or nucleic acid molecules of the present invention. A vector may additionally include nucleic acid sequences that permit it to replicate in the host cell, such as an origin of replication, one or more therapeutic genes and/or selectable marker genes and other genetic elements known in the art such as regulatory elements directing transcription, translation and/or secretion of the encoded protein. The vector may be used to transduce, transform or infect a cell, thereby causing the cell to express nucleic acids and/or proteins other than those native to the cell. The vector optionally includes materials to aid in achieving entry of the nucleic acid into the cell, such as a viral particle, liposome, protein coating or the like.

The present invention also relates to host cells, which are genetically engineered with vectors of the invention and to the production of the polypeptides according to the present invention by recombinant techniques.

A great variety of expression vectors can be used to express the polypeptides according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and the polypeptides according to the present invention. Nucleic acid constructs in host cells can be used in a conventional manner to produce the gene product encoded by the recombinant sequence. Alternatively, the polypeptides according to the preset invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as streptococci, staphylococci, *E. coli*, *Streptomyces* and *Bacillus subtilis* cells; fungal cells, such as yeast cells and *Aspergillus* cells; insect cells such as *Drosophila* S2 and *Spodoptera* Sf9 cells; animal cells such as CHO, COS, HeLa, C127, 3T3, BHK, 293 and Bowes melanoma cells; and plant cells.

The host cells can be transfected, e.g. by conventional means such as electroporation with at least one expression vector containing a nucleic acid of the invention under the control of a transcriptional regulatory sequence.

According to another aspect of the present invention, a comprehensive set of novel polypeptides is provided. Such polypeptides, as mentioned previously herein, are antigens as disclosed herein, and the fragments thereof, preferably the active fragments thereof, and the variants thereof, preferably the active variants thereof. Preferably, the polypeptides according to the present invention are antigens and fragments thereof. In a preferred embodiment of the invention, an antigen comprising an amino acid sequence being preferably encoded by any one of the nucleic acids molecules and fragments thereof as described herein, are provided. In another preferred embodiment of the invention a novel set of proteins and antigens and active fragments as well as active variants thereof is provided which comprise amino acid sequences selected from the group comprising Seq ID Nos 188 to 374 and Seq ID No 376.

The polypeptides according to the present invention, i.e. the antigens, as provided by the present invention preferably include any polypeptide or molecule set forth in the Sequence Listing as well as polypeptides which have at least 70% identity to such polypeptide according to the present invention, preferably at least 80% or 85% identity to such polypeptide according to the present invention, and more preferably at least 90% similarity (more preferably at least 90% identity) to such polypeptide according to the present invention and more preferably as set forth in the Sequence Listing and still more preferably at least 95%, 96%, 97%, 98%, 99% or 99.5% similarity (still more preferably at least 95%, 96%, 97%, 98%, 99%, or 99.5% identity) to such polypeptide according to the present invention and also include portions of such polypeptides with such portion of the polypeptide generally containing at least 4 amino acids and more preferably at least 8, still more preferably at least 30, still more preferably at most 50 amino acids, such as 4, 8, 10, 20, 30, 35, 40, 45 or 50 amino acids. In a preferred embodiment such portions are active fragments of the polypeptides according to the present invention.

The invention also relates to fragments, analogs, and derivatives of the polypeptides according to the present invention. The terms "fragment", "derivative" and "analog" when referring to such polypeptide whose amino acid sequence is preferably set forth in the Sequence Listing, means a polypeptide which retains essentially the same or a similar biological activity as such polypeptide. It will be acknowledged by the ones skilled in the art that the meaning of the term "similar biological activity" as used herein preferably depends on the polypeptide under consideration and more specifically its function. The term "biological activity" as used herein is further defined below. More preferably, a similar biological function or activity differs from the function of the non-fragment or the non-derivative in terms of extent of activity, affinity, immunogenicity, stability and/or specificity. In a preferred embodiment the difference is less than 50%, less than 75% or less than 90%.

In an embodiment the fragment, derivative, variant or analog of a polypeptide according to the present invention is 1) one in which one or more of the amino acid residues are substituted with a conserved or non-conserved amino acid residue (preferably a conserved amino acid residue) and such substituted amino acid residue may or may not be one encoded by the genetic code, or 2) one in which one or more of the amino acid residues includes a substituent group, or 3) one in the polypeptide according to the present invention or a fragment thereof is fused with another compound, such as a compound to increase the half-life of the polypeptide according to the present invention or a fragment thereof such as, for example, polyethylene glycol, or 4) one in which the additional amino acids are fused to the polypeptide according to the present invention or a fragment thereof, such as a leader or secretory sequence or a sequence which is employed for purification of said polypeptide according to the present invention or fragment thereof or a proprotein sequence. Such fragments, derivatives, variants and analogs are deemed to be within the scope of those skilled in the art from the teachings herein.

The present invention also relates to proteins and antigens of different *Klebsiella* species, preferably pathogenic *Klebsiella* species, especially *K. pneumoniae* including the three subspecies *pneumoniae, ozaenae* and *rhinoscleromatis, K. oxytoca, K. planticola, K. terrigena,* and *K. ornithinolytica,* and more preferably from *K. pneumoniae* or *K. oxytoca* which are preferably homologues. Such homologues may easily be isolated based on the nucleic acid and amino acid sequences disclosed herein. There are multiple serotypes or clinical strains distinguished to date for each of the pathogens and the typing is based on serotype specific antisera or molecular approaches. The presence of any antigen can accordingly be determined for every serotype. The contribution of the various serotypes to the different *Klebsiella* infections varies in different age groups and especially geographical regions. Particularly relevant serotypes of *Klebsiella* are, for example, K1, K2, K3, K10, K21, K22, K30, K55, K64, O1, O2a, O3, O4, O5, or O12, or any combination of said K and said O serotypes. It is an important aspect that the most valuable protective antigens need to be conserved among various clinical strains.

Additionally, fusion polypeptides comprising such antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression of a recombinant polynucleic acid encoding a fusion protein.

Among preferred variants are those that vary from a reference by conservative amino acid substitutions. Such substitutions are those that substitute a given amino acid in a polypeptide according to the present invention by another amino acid of like characteristics. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

In another embodiment of the invention the peptide as defined above may be modified by a variety of chemical techniques to produce derivatives having essentially the same activity (as defined above for fragments and variants) as the modified peptides, and optionally having other desirable properties. For example, carboxylic acid groups of the protein, whether C-terminal or side chain, may be provided in the form of a salt of a pharmaceutically acceptable cation or esterified to form an ester, or converted to an amide. Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be converted to an amide. Hydroxyl groups of the peptide side chains may be converted to alkoxy or to an ester using well recognized techniques. Phenyl and phenolic rings of the peptide side chains may be substituted with one or more halogen atoms, such as fluorine, chlorine, bromine or iodine, or with alkyl, alkoxy, carboxylic acids and esters thereof, or amides of such carboxylic acids. Thiols can be protected with any one of a number of well recognized protecting groups, such as acetamide groups.

Further particularly preferred in this regard are variants, analogs, derivatives and fragments, and variants, analogs and derivatives of the fragments, having the amino acid sequence of any polypeptide according to the present invention as disclosed herein and preferably set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the peptide of the present invention. Also especially preferred in this regard are conservative substitutions. Most highly preferred are peptides having an amino acid sequence set forth in the Sequence Listing without substitutions.

Variants of any of the antigens in their various embodiments disclosed herein and in particular the antigens and peptides specified herein by Seq ID Nos 188 to 374 and Seq ID No 376, can typically also be characterized by means of bioinformatics. Respective tools such as the NCBI Basic Local Alignment Search Tool (BLAST) (Altschul et al., 1990) are available from several sources, including the National Center for Biotechnology Information (NCBI, Bethesda, Md.) and on the Internet, for use in connection with the sequence analysis programs blastp, blastn, blastx, tblastn and tblastx. Using the NCBI Blast 2.0, gapped blastp set to default parameters. For comparisons of amino acid sequences of at least 35 amino acids, the Blast 2 sequences function is employed using the default BLOSUM62 matrix set to default parameters, (gap existence cost of 11, and a per residue gap cost of 1). When aligning short peptides (fewer than around 35 amino acids), the alignment is performed using the Blast 2 sequences function, employing the PAM30 matrix set to default parameters (open gap 9, extension gap 1 penalties). Methods for determining sequence identity over such short windows such as 15 amino acids or less are described at the website that is maintained by the National Center for Biotechnology Information in Bethesda, Md.

The active variant of an antigen is obtained by sequence alterations in the antigen, including each and any variant, fragment, analogue or derivative thereof, if not explicitly indicated to the contrary, wherein the polypeptide according to the present invention with the sequence alterations retains a function of the unaltered polypeptide according to the present invention, e.g. having a biological activity similar to that displayed by the complete antigen, including the ability to induce an immune response and/or to show protection against a *Klebsiella* organism e.g. in a sepsis and/or lethality model. A further example of retaining the function of the unaltered polypeptide according to the present invention is that the active variant of the antigen specifically binds a polypeptide specific antibody that binds an unaltered form of the polypeptide according to the present invention. By "biological function" or "biological activity" is preferably meant a function of the polypeptide in cells or organisms in which it naturally occurs, even if the function is not necessary for the growth or survival of the cells and organisms, respectively. For example, the biological function of a porin is to allow the entry into cell of compounds present in the extracellular medium. The biological function is distinct from the antigenic function. A polypeptide according to the present invention can have more than one biological function.

The sequence alterations of such variants can include, but are not limited to, conservative substitutions, deletions, mutations and insertions. Preferably, the active variant exhibits reactivity with human sera of septicaemia patients, more preferably mediates seroconversion and most preferably shows bactericidal activity. These characteristics of the active variant can be assessed e.g. as detailed in the Examples. In the context of the present invention a variant specifically binds a specific antibody (preferably being polyclonal antibodies raised against recombinant proteins in animals such as mouse, rabbit or monoclonal antibodies generated in mouse), exhibits reactivity with human sera from patients with septicaemia, mediates seroconversion or shows bactericidal activity, if the activity of the variant amounts to at least 10%, preferably at least 25%, more preferably at least 50%, even more preferably at least 70%, still more preferably at least 80%, especially at least 90%, particularly at least 95%, most preferably at least 99% of the activity of the antigen without sequence alterations.

Said active variants include naturally-occurring allelic variants, as well as mutants or any other non-naturally occurring variants. As is known in the art, an allelic variant is an alternate form of a (poly)peptide that is characterized as having a substitution, deletion, or addition of one or more amino acids that does essentially not alter the biological function of the polypeptide, as it is described above.

Within any species of the living world, allelic variation is the rule. For example, any bacterial species, e.g. *K. pneumoniae*, is usually represented by a variety of strains (characterized by clonal reproduction) that differ from each other by minor allelic variations. Indeed, a polypeptide that fulfils the same biological function in different strains can have an amino acid sequence that is not identical in each of the strains. Such an allelic variation is equally reflected at the polynucleotide level.

Allelic variation is very common within the *Klebsiella* species as described for class A beta-lactamase K2 (Haeggman, S. et al., 1997).

In a preferred embodiment, the active variant of or the active fragment derived from the polypeptide according to the present invention by amino acid exchanges, deletions or insertions may also conserve, or more preferably improve, the activity (reactivity, seroconversion and/or bactericidal activity as defined herein). Furthermore, these polypeptides may also cover epitopes, which trigger the same or preferably an improved T cell response. These epitopes are referred to as "heteroclitic" as further defined herein. They have a similar or preferably greater affinity to MHC/HLA molecules, and the ability to stimulate the T cell receptors (TCR) directed to the original epitope in a similar or preferably stronger manner. Heteroclitic epitopes can be obtained by rational design i.e. taking into account the contribution of individual residues to binding to MHC/HLA as for instance described by Rammensee et al. (1999), combined with a systematic exchange of residues potentially interacting with the TCR and testing the resulting sequences with T cells directed against the original epitope. Such a design is possible for a skilled person in the art without undue experimentation.

In a still more preferred embodiment of the invention the active variant of a polypeptide according to the present invention is any of the polypeptides disclosed herein and more specifically any of the polypeptides defined by the Seq ID Nos 188 to 374 and Seq ID No 376, having at least 50% sequence identity to the polypeptides of any of said Seq ID Nos 188 to 374 and Seq ID No 376, especially at least 60%, preferably at least 70%, more preferably at least 80%, still more preferably at least 90%, even more preferably at least 95%, 96%, 97%, 98%, most preferably 99% sequence identity to the polypeptides of any of said Seq ID Nos 188 to 374 and Seq ID No 376 and/or is derived from said polypeptides of any of the sequences of Seq ID Nos 188 to 374 and Seq ID No 376 by conservative substitutions. Conservative substitutions are those that take place within a family of amino acids that are related in their side chains and chemical properties. Examples of such families are amino acids with basic side chains, with acidic side chains, with non-polar aliphatic side chains, with non-polar aromatic side chains, with uncharged polar side chains, with small side chains, with large side chains etc. In one embodiment, one conservative substitution is included in the peptide. In another embodiment, two conservative substitutions or less are included in the peptide. In a further embodiment, three conservative substitutions or less are included in the peptide.

Examples of conservative amino acid substitutions include, but are not limited to, those listed below:

| Original Residue | Conservative Substitutions |
|---|---|
| Ala | Ser |
| Arg | Lys |
| Asn | Gln; His |
| Asp | Glu |
| Cys | Ser |
| Gln | Asn |
| Glu | Asp |
| His | Asn; Gln |
| Ile | Leu; Val |
| Leu | Ile; Val |
| Lys | Arg; Gln; Asn |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

The polypeptides according to the present invention, and fragments and variants thereof, also include or consist of modified epitopes wherein preferably one or two of the amino acids of a given epitope are modified or replaced according to the rules disclosed in, e.g., Tourdot, S. et al., 2000, as well as the nucleic acid sequences encoding such modified epitopes. The epitopes as presented by the polypeptides according to the present invention are also referred to herein as the present epitopes.

It is clear that also epitopes derived from the present epitopes by amino acid exchanges improving, conserving or at least not significantly impeding the T cell activating capability of the epitopes are covered by the epitopes according to the present invention. Therefore the present epitopes also cover epitopes, which do not contain the original sequence as derived from *K. pneumoniae*, but trigger the same or preferably an improved T cell response. These epitope are referred to as "heteroclitic"; they need to have a similar or preferably greater affinity to MHC/HLA molecules, and the need the ability to stimulate the T cell receptors (TCR) directed to the original epitope in a similar or preferably stronger manner.

Another possibility for identifying epitopes and more specifically heteroclitic epitopes includes the screening of peptide libraries with T cells directed against one or several of the present epitopes. A preferred way is the positional scanning of synthetic peptide libraries. Such approaches have been described in detail for instance by Hemmer, B. et al., (1999) and the references given therein.

As an alternative to epitopes represented by the present derived amino acid sequences or heteroclitic epitopes as disclosed herein, also substances or compounds mimicking these epitopes which are also referred to herein as "peptidemimetica" or "retro-inverse-peptides" can be applied and are thus within the present invention.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

The polypeptides according to the present invention are preferably provided in an isolated form, and preferably are purified to homogeneity.

In another embodiment of the present invention the variant is a fragment. The fragment is characterized by being derived from the antigen as defined above by one or more amino acid deletions. The deletion(s) may be C-terminally, N-terminally and/or internally. Preferably the fragment is obtained by at most 10, 20, 30, 40, 50, 60, 80, 100, 150 or 200, more preferably by at most 10, 20, 30, 40 or 50, even more preferably at most 5, 10 or 15, still more preferably at most 5 or 10, most preferably 1, 2, 3, 4 or 5 deletion(s). The active fragment of the invention is characterized by having a biological activity similar to that displayed by the complete antigen, including the ability to induce immunization and/or to show protection against *Klebsiella* e.g. in a sepsis and/or lethality model. The fragment of an antigen is active in the context of the present invention, if the activity of the fragment amounts to at least 10%, preferably at least 25%, more preferably at least 50%, even more preferably at least 70%, still more preferably at least 80%, especially at least 90%, particularly at least 95%, most preferably at least 99% of the activity of the antigen without sequence alteration. These fragments may be designed or obtained in any desired length, including as small as about 50 to 80 amino acids in length.

In a further embodiment a fragment, and more preferably a fragment, of the polypeptide according to the present invention are characterised by structural or functional attributes, i.e. fragments that comprise alpha-helix and alpha-helix forming regions, beta-sheet and beta-sheet forming regions, turn and turn-forming regions, coil and coil-forming regions, hydrophilic regions, hydrophobic regions, alpha-amphipathic regions, beta-amphipathic regions, flexible regions, surface-forming regions, substrate binding regions, and high antigenic index regions of the polypeptide according to the present invention, and combinations of such fragments. Preferred regions are those that mediate antigenicity and antibody binding activities of the polypeptides according to the present invention. Most highly preferred in this regard are fragments that have a chemical, biological or other activity of the antigen and fragments thereof of the present invention, including those with a similar activity or an improved activity, whereby such improved activities are immunogenicity and stability, or with a decreased undesirable activity, whereby such decreased undesirable activity is enzymatic and toxic function and generation of human cross-reactive antibodies. Particularly preferred are fragments comprising receptors or domains of enzymes that confer a function essential for viability of *Klebsiellae* or any other pathogenic *Klebsiella* species, or the ability to cause disease in humans. Further preferred fragments of the polypeptides according to the present invention are those that comprise or contain antigenic or immunogenic determinants in an animal, especially in a human. Such fragments are also referred to as antigenic fragment.

An antigenic fragment is preferably defined as a fragment, which is antigenic by itself or may be made antigenic when provided as a hapten. Therefore, also antigens or antigenic fragments showing one or, particularly for longer fragments, only a few amino acid exchanges are enabled by the present invention, provided that the antigenicity or antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of the polypeptides according to the invention are those listed in Table 16 (SED ID NOs 188-203 and 376).

Further preferred examples of such fragments of the polypeptides according to the present invention are the core amino acid sequence as indicated in column "Predicted immunogenic aa" or "Location of identified immunogenic region" of Table 1, or as defined by columns "From aa" and "To aa" of Table 4, or as indicated in column "Location in protein (aa)" of Table 5.

All these fragments listed in tables 1, 4 and 5 individually and each independently form a preferred selected aspect of the present invention.

It will be appreciated that the invention also relates to, among others, nucleic acid molecules encoding the aforementioned fragments, variants, active variants, and active fragments, nucleic acid molecules that hybridise to nucleic acid molecules encoding the fragments, variants, active variants, and active fragments, particularly those that hybridise under stringent conditions, and nucleic acid molecules, such as PCR primers, for amplifying nucleic acid molecules that encode the fragments. In these regards, preferred nucleic acid molecules are those that correspond to the preferred fragments, as discussed above.

The polypeptides according to the present invention may be expressed in a modified form, such as a fusion protein, and may include not only secretion signals but also additional heterologous functional regions. Thus, for instance, a region of additional amino acids, particularly charged amino acids, may be added to the N- or C-terminus of the polypeptide to improve stability and persistence in the host cell, during purification or during subsequent handling and storage. Also, regions may be added to the polypeptide to facilitate purification or to enhance expression. Such regions may be removed prior to final preparation of the polypeptide. The addition of peptide moieties to polypeptides to engender secretion or excretion, to improve stability, to enhance expression or to facilitate purification, among others, are familiar and routine techniques in the art. A preferred fusion protein comprises a heterologous region from immunoglobulin that is useful to solubilize or purify polypeptides. For example, EP 0 464 533 discloses fusion proteins comprising various portions of constant region of immunoglobin molecules together with another protein or part thereof. In drug discovery, for example, proteins have been fused with antibody Fc portions for the purpose of high-throughout screening assays to identify antagonists. See for example, (Bennett, D. et al., 1995) and (Johanson, K. et al., 1995). Fusions also may include the polypeptides according to the present invention fused or coupled to moieties other than amino acids, including lipids and carbohydrates. Further, antigens of this invention may be employed in combination with other vaccinal agents described by the prior art, as well as with other species of vaccinal agents derived from other microorganisms. Such proteins are useful in the prevention, treatment and diagnosis of diseases caused by a wide spectrum of *Klebsiella* isolates.

In a further embodiment the peptide of the invention is fused to an epitope tag which provides an epitope to which an anti-tag substance can selectively bind. The epitope tag is generally placed at the amino- or carboxyl-terminus of the peptide but may be incorporated as an internal insertion or substitution as the biological activity permits. The presence of such epitope-tagged forms of a peptide can be detected using a substance such as an antibody against the tagged peptide. Also, provision of the epitope tag enables the peptide to be readily purified by affinity purification using an anti-tag antibody or another type of affinity matrix that binds to the epitope tag. Various tag polypeptides and their respective antibodies are well known in the art. Examples include poly-histidine (poly-his), poly-histidine-glycine (poly-his-gly) tags, the HA tag polypeptide, the c-myc tag, the Strep tag and the FLAG tag.

The polypeptides of the invention may be prepared by any of a number of conventional techniques. For example, they can be produced by chemical synthesis as well as by biotechnological means. The latter comprise the transfection or transformation of a host cell with a vector containing a nucleic acid according to the present invention. In a preferred embodiment the vector is a vector according to the present invention. The biotechnological production of the polypeptides according to the present invention further comprises the cultivation of the transfected or transformed host cell under conditions, that allow expression of the protein and which are known to the one skilled in the art. The expressed protein is recovered, isolated, and optionally purified from the cell (or from the culture medium, if expressed extracellularly) by appropriate means known to one of skill in the art. For example, the proteins are isolated in soluble form following cell lysis, or extracted using known techniques, e.g. in guanidine chloride. The molecules comprising the polypeptides and antigens of this invention may be further purified using any of a variety of conventional methods including, but not limited to: ammonium sulfate or ethanol precipitation, acid extraction, liquid chromatography such as normal or reversed phase, using HPLC, FPLC and the like; affinity chromatography (such as with inorganic ligands or monoclonal antibodies), size exclusion chromatography, anion or cation exchange chromatography, phosphocellulose chromatography, hydrophobic interaction chromatography, hydroxylapatite chromatography, lectin chromatography, immobilized metal chelate chromatography, gel electrophoresis, and the like. One of skill in the art may select the most appropriate isolation and purification techniques without departing from the scope of this invention. Such purification provides the antigen in a form substantially free from other proteinaceous and non-proteinaceous materials of the microorganism.

An alternative approach to prepare polypeptides according to the invention involves generating the fragments of known peptides by enzymatic digestion, e.g., by treating the protein with an enzyme known to cleave proteins at sites defined by particular amino acid residues, or by digesting the DNA with suitable restriction enzymes, expressing the digested DNA and isolating the desired fragment. Yet another suitable technique involves isolating and amplifying a DNA fragment encoding a desired peptide fragment, by polymerase chain reaction (PCR). Oligonucleotides that define the desired termini of the DNA fragment are employed as the 5' and 3' primers in the PCR. Techniques for making mutations, such as deletions, insertions and substitutions, at predetermined sites in DNA, and therefore in proteins, having a known sequence are well known. One of skill in the art using conventional techniques, such as PCR, may readily use the antigens and peptides provided herein to identify and isolate other similar proteins. Such methods are routine and not considered to require undue experimentation, given the information provided herein. For example, variations can be made using oligonucleotide-mediated site-directed mutagenesis (Carter, P. et al., 1986; Zoller, M. J. et al., 1987), cassette mutagenesis (Wells, J. A. et al., 1985), restriction selection mutagenesis (Wells et al., 1986), PCR mutagenesis, or other known techniques can be performed on the cloned DNA to produce the peptide of the invention.

The polypeptide according to the present invention may be used for the detection of the organism or organisms in a sample containing these organisms or proteins or antigens, including fragments thereof. Preferably such detection is for diagnosis, more preferable for the diagnosis of a disease, most preferably for the diagnosis of a disease related or linked to the presence or abundance of Gram-negative bacteria, especially bacteria selected from the group comprising pathogenic *Klebsiella* species, especially *K. pneumoniae* including the three subspecies *pneumoniae, ozaenae* and *rhinoscleromatis, K. oxytoca, K. planticola, K. terrigena,* and *K. ornithinolytica*, and more preferably from *K. pneumoniae* or *K. oxytoca*.

The nucleic acids according to the present invention can also be used for the diagnosis or detection of organisms or organisms in a sample, whereby the organisms are preferably the same ones as disclosed in connection with the use of the polypeptides according to the present invention and the antibody according to the present invention, respectively. Basically, it is within the skills of the person of the art to design and practice such diagnosis and detection assays and methods, respectively, in the light of the present disclosure. More preferably such diagnosis or detection uses primers or probes to specifically interact with the nucleic acid molecules according to the present invention. The length and design of such primers and probes, respectively, varies depending on the particular method or diagnosis practiced. Using, in a preferred embodiment, a primer for, e.g., a PCR based detection or diagnosis system, i.e. method or assay, the length of the primer will range from about 10 nucleotides to about 30 nucleotides and more preferably from about 16 to 25 nucleotides. In case of a probe based detection or diagnosis system the length of the probe is preferably about the same as specified for the primer based system. Additionally, in case of a probe based system, the probe will comprise a moiety which allows its detection, either directly or indirectly. Such moiety for direct detection can be a radioactive label or a fluorescence label as known to the ones skilled in the art. Such moiety for indirect detection can be a biotin or any other moiety which mediates interaction with a further compound which in turn is labelled so as to allow its detection.

The present invention also relates to diagnostic assays such as quantitative and diagnostic assays for detecting levels of the polypeptides according to the present invention and more preferably antigens and fragments thereof of the present invention in cells and tissues, including determination of normal and abnormal levels. Thus, for instance, a diagnostic assay in accordance with the invention for detecting overexpression of the polypeptides according to the present invention compared to normal control tissue samples may be used to detect the presence of an infection, for example, and to identify the infecting organism. Assay techniques that can be used to determine levels of such polypeptides in a sample derived from a host are well known to those of skill in the art. Such assay methods include radioimmunoassays, competitive-binding assays, Western Blot analysis and ELISA assays. Among these, ELISA and Western Blot analysis frequently are preferred. An ELISA assay initially comprises preparing an antibody specific to one of the polypeptides according to the present invention, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme. One or several of the polypeptides according to the present invention and more preferably an antigen and fragment thereof according to the present invention may be immobilised on ELISA plates for detection of reactive antibodies in sera of patients or subjects to be tested.

A Western blot assay initially separates the polypeptides according to the present invention individually or in combination by SDS-polyacrylamide gelelectrophoresis and which subsequently are transferred and immobilised onto a solid support matrix, such as nitrocellulose, nylon or combinations thereof. Together with a reporter antibody reactive antibodies can be detected. The reporter antibody is attached to a detectable reagent such as radioactive, fluorescent or enzymatic reagent, such as horseradish peroxidase enzyme.

The polypeptides according to the present invention or the nucleic acid molecules according to the present invention or primers or probes directed thereto as described herein, may also be used for the purpose of or in connection with an array. In case of the nucleic acid molecule according to the present invention and the primers and probes directed thereagainst, the length of the probes and the primer, can also preferably be in the range from about 25 to about 75 nucleotides, more preferably from about 35 to about 50 nucleotides. More particularly, at least one of the polypeptides according to the present invention may be immobilized on a support. Said support typically comprises a variety of the polypeptides according to the present invention and/or antigens and fragments thereof whereby the variety may be created by using one or several of the antigens and fragments thereof according to the present invention and/or antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different polypeptides and more preferably different antigens and fragments thereof immobilized on a support may range from as little as 10 to several 1,000 different polypeptides and antigens and fragments thereof, respectively. The density of said molecules per $cm^2$ is in a preferred embodiment as little as 10 per $cm^2$ to at least 400 different of such polypeptides per $cm^2$ and more particularly at least 1,000 different of such polypeptides and more preferably different antigens and fragments thereof per $cm^2$. What is said herein about the immobilization of the polypeptides according to the present invention and their use, is also applicable to the nucleic acid molecules and the primers and probes, respectively, directed thereagainst, as will be acknowledged by the ones skilled in the art.

The manufacture of such arrays is known to the one skilled in the art and, for example, described in U.S. Pat. No. 5,744, 309. The array preferably comprises a planar, porous or non-porous solid support having at least a first surface. The polypeptides according to the present invention are immobilized on said surface. Preferred support materials are, among others, glass or cellulose. It is also within the present invention that the array is used for any of the diagnostic applications described herein. Apart from the polypeptides according to the present invention also the nucleic acid molecules according to the present invention may be used for the generation of an array as described above which, in principle, can be used for any of the purposes disclosed for the array containing polypeptides. This applies as well to an array made of antibodies, preferably monoclonal antibodies as, among others, described herein.

In a further aspect the present invention relates to an antibody directed to any of polypeptides according to the present invention, derivatives, fragments, variants, active fragments and active variants thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i.e. that different parts thereof stem from different species or at least the respective sequences are taken from different species.

Such antibodies in general and in particular directed against the antigens and fragments thereof corresponding to a sequence of the present invention can be obtained by direct injection of a polypeptide according to the present invention into an animal or by administering said polypeptide to an animal, preferably a non-human. The antibody so obtained will then bind said polypeptide itself. In this manner, even a sequence encoding only a fragment said polypeptide can be used to generate antibodies binding the whole native polypeptides according to the present invention. Such antibodies can then be used to isolate the polypeptide according to the present invention from tissue expressing antigens and fragments thereof. It will be understood by the ones skilled in the art that this procedure is also applicable to the fragments, variants, active fragments and active variants thereof of said polypeptides.

For preparation of monoclonal antibodies, any technique known in the art, which provides antibodies produced by continuous cell line cultures can be used (as described originally in (Kohler, G. et al., 1975)).

Techniques described for the production of single chain antibodies (U.S. Pat. No. 4,946,778) can be adapted to produce single chain antibodies to immunogenic antigens and fragments thereof in their diverse embodiments according to this invention. Also, transgenic mice, or other organisms such as other mammals, may be used to express humanized antibodies to the polypeptides according to the present invention.

Still another aspect of the invention relates to a hybridoma cell line which produces the antibody of the invention.

Hybridoma cell lines expressing desirable monoclonal antibodies are generated by well-known conventional techniques. The hybridoma cell can be generated by fusing a normal-activated, antibody-producing B cell with a myeloma cell. In the context of the present invention the hybridoma cell is able to produce an antibody specifically binding to the antigen of the invention.

Similarly, desirable high titer antibodies are generated by applying known recombinant techniques to the monoclonal or polyclonal antibodies developed to these antigens (see, e.g., PCT Patent Application No. PCT/GB85/00392; British Patent Application Publication No. GB2188638A; Amit, A. G. et al., 1986; Queen, C. et al., 1989; PCT Patent Application No. WO90/07861; Riechmann, L. et al., 1988; Huse, W. D. et al., 1988).

Alternatively, phage display technology or ribosomal display could be utilized to select antibody genes with binding activities towards the polypeptides according to the present invention either from repertoires of PCR amplified v-genes of lymphocytes from humans screened for possessing respective target antigens or from naïve libraries (McCafferty, J. et al., 1990); (Marks, J. et al., 1992). The affinity of these antibodies can also be improved by chain shuffling (Clackson, T. et al., 1991).

If two antigen binding domains are present, each domain may be directed against a different epitope—termed 'bispecific' antibodies.

The above-described antibodies may be employed to isolate or to identify clones expressing the polypeptides according to the present invention by attachment of the antibody to a solid support for isolation and/or purification by affinity chromatography.

Thus, among others, antibodies against the polypeptides according to the present invention may be employed to inhibit and/or treat infections, particularly bacterial infections and especially infections arising from pathogenic *Klebsiella* species, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

The polypeptides according to the present invention and more specifically antigens and fragments thereof in their diverse embodiments include antigenically, epitopically or immunologically equivalent derivatives, which form a particular aspect of this invention. The term "antigenically equivalent derivative" as used herein encompasses such polypeptide according to the present invention or its equivalent which will be specifically recognized by certain antibodies which, when raised to said polypeptide, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The polypeptides according to the present invention and more specifically the antigens and fragments thereof in their diverse embodiments, such as an antigenically or immunologically equivalent derivative or a fusion protein thereof can be used as an antigen to immunize a mouse or other animal such as a rat or chicken. The fusion protein may provide stability to the polypeptide according to the present invention. Such polypeptide may be associated, for example by conjugation, with an immunogenic carrier protein, for example bovine serum albumin (BSA) or keyhole limpet haemocyanin (KLH). Alternatively, an antigenic peptide comprising multiple copies of the polypeptide according to the present invention and more preferably an antigen and fragments thereof, or an antigenically or immunologically equivalent antigen and fragments thereof, may be sufficiently antigenic to improve immunogenicity so as to obviate the use of a carrier.

Preferably the antibody or derivative thereof is modified to make it less immunogenic in the individual. For example, if the individual is human the antibody may most preferably be "humanized", wherein the complementarity determining region(s) of the hybridoma-derived antibody has been transplanted into a human monoclonal antibody, for example as described in (Jones, P. et al., 1986) or (Tempest, P. et al., 1991).

The use of a nucleic acid molecule according to the present invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment (Tang, D. et al., 1992), (Eisenbraun, M. et al., 1993) and in vivo infection using cloned retroviral vectors (Seeger, C. et al., 1984).

In a further aspect the present invention relates to a peptide binding to any of the polypeptides according to the present invention, and a method for the preparation of such peptides whereby the method is characterized by the use of said polypeptide and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a polypeptide according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e.g. by propagating the peptide encoding phages. The characterisation preferably comprises the sequencing of the target binding peptides. Basically, the peptides are not limited in their lengths, however preferably peptides having a length from about 8 to 20 amino acids are preferably obtained in the respective methods. The size of the libraries may be about $10^2$ to $10^{18}$, preferably $10^8$ to $10^{15}$ different peptides, however, is not limited thereto. In a preferred embodiment such peptides are high-affinity binding peptides. In an even more preferred embodiment the peptides are peptide aptamers.

A particular form of target binding peptides as described above, are the so-called "anticalines" which are, among others, described in German patent application DE 19742706. In so far, the present invention is also related to peptides specifically binding to the polypeptides according to the present invention and the use thereof for any of the therapeutic and diagnostic applications described herein, preferably for antibodies.

In a further aspect the present invention relates to functional nucleic acids interacting with any of the polypeptides according to the present invention, and a method for the preparation of such functional nucleic acids whereby the method is characterized by the use of the polypeptides according to the present invention and the basic steps are known to the one skilled in the art. The functional nucleic acids are preferably aptamers and spiegelmers. In so far, the present invention is also related to aptamers and spiegelmers specifically binding to the polypeptides according to the present invention and the use thereof for any of the therapeutic and diagnostic applications described herein, preferably for antibodies.

Aptamers are D-nucleic acids, which are either single stranded or double stranded and which specifically interact with a target molecule. The preparation or selection of aptamers is, e.g. described in European patent EP 0 533 838. Basically the following steps are realized. First, a mixture of nucleic acids, i.e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to as aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e.g., by introducing defined chemical groups which are known to the one skilled in the art of generating aptamers. Such modification may for example reside in the introduction of an amino group at the 2'-position of the sugar moiety of the nucleotides. Aptamers are currently used as therapeutic agents. However, it is also within the present invention that the thus selected or generated aptamers may be used for target validation and/or as lead substance for the development of pharmaceutical compositions, preferably of pharmaceutical compositions based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or preparation is based on a similar principle. The preparation of spiegelmers is described in international patent application WO 98/08856. Spiegelmers are L-nucleic acids, which means that they are composed of L-nucleotides rather than D-nucleotides as aptamers are. Spiegelmers are characterized by the fact that they have a very high stability in biological systems and, comparable to aptamers, specifically interact with the target molecule against which they are directed. In the process of generating spiegelmers, a heterogeneous population of D-nucleic acids is created and this population is contacted with the optical antipode of the target molecule, in the present case for example with the D-enantiomer of the naturally occurring L-enantiomer of the antigens and fragments thereof according to the present invention. Subsequently, those D-nucleic acids are separated which do not interact with the optical antipode of the target molecule. But those D-nucleic acids interacting with the optical antipode of the target molecule are separated, optionally identified and/or sequenced and subsequently the corresponding L-nucleic acids are synthesized based on the nucleic acid sequence information obtained from the D-nucleic acids. These L-nucleic acids, which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the preparation of such functional nucleic acids whereby the method is characterized by the use of the nucleic acid molecules and their respective sequences according to the present invention and the basic steps are known to the one skilled in the art. The functional nucleic acids are preferably ribozymes, antisense oligonucleotides and siRNA. In so far, the present invention is also related to this kind of functional nucleic acid specifically binding to the polypeptides according to the present invention and the use thereof for any of the therapeutic and diagnostic applications described herein, preferably for antibodies.

Ribozymes are catalytically active nucleic acids, which preferably consist of RNA, which basically comprises two moieties. The first moiety shows a catalytic activity whereas the second moiety is responsible for the specific interaction with the target nucleic acid, in the present case the nucleic acid coding for the polypeptides according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid, which in the end results in the degradation of the target nucleic acid as well as the protein derived from the said target nucleic acid. Ribozymes, their use and design principles are known to the one skilled in the art, and, for example described in (Doherty, E. et al., 2001) and (Lewin, A. et al., 2001).

The activity and design of antisense oligonucleotides for the preparation of a pharmaceutical composition and as a diagnostic agent, respectively, is based on a similar mode of action. Basically, antisense oligonucleotides hybridise based on base complementarity, with a target RNA, preferably with a mRNA, thereby activating RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybrid complexes. Examples for this kind of antisense oligonucleotides are described, among others, in U.S. Pat. No. 5,849,902 and U.S. Pat. No. 5,989,912. In other words, based on the nucleic acid sequence of the target molecule which in the present case are the nucleic acid molecules for the antigens and fragments thereof according to the present invention, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides, which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2''-O-methyl or 2'-fluoro. Alternative approaches used methylphosphonate or phosphoramidate linkages in said arms. Further embodiments of the antisense oligonucleotide useful in the practice of the present invention are P-methoxyoligonucleotides, partial P-methoxyoligodeoxy-ribonucleotides or P-methoxyo ligodeoxy-ribonucleotides.

Of particular relevance and usefulness for the present invention are those antisense oligonucleotides as more particularly described in the above two mentioned US patents. These oligonucleotides contain no naturally occurring 5''=>3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eukaryotic and, particularly, mammalian RNase H.

Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from position 11 to 59 5'=>3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3''-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

The nucleic acids as well as the polypeptides according to the present invention in their diverse embodiments may be used as or for the preparation of pharmaceutical compositions, especially vaccines. Preferably such pharmaceutical composition, preferably vaccine is, for the prevention or treatment of diseases caused by, related to or associated with *Klebsiella* species, preferably pathogenic *Klebsiella*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. In so far another aspect of the invention relates to a method for inducing an immunological response in an individual, particularly a mammal, which comprises inoculating the individual with the polypeptides according to the present invention in their diverse embodiments, or a fragment or variant thereof, adequate to produce antibodies to protect said individual from infection by the above microorganisms.

Yet another aspect of the invention relates to a method of inducing an immunological response in an individual which comprises, through gene therapy or otherwise, delivering a nucleic acid molecule according to the present invention, preferably functionally encoding antigens and fragments thereof in their diverse embodiments, for expressing the polypeptide according to the present invention in vivo in order to induce an immunological response to produce antibodies or a cell mediated T cell response, either cytokine-producing T cells or cytotoxic T cells, to protect said individual from disease, whether that disease is already established within the individual or not. One-way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses at least one of the polypeptides according to the present invention in their diverse embodiments. The immunological response may be used therapeutically or prophylactically and may take the form of antibody immunity or cellular immunity such as that arising from CTL or CD4+ T cells.

The polypeptides according to the present invention in their diverse embodiments may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof. Moreover, the co-protein may act as an adjuvant in the sense of providing a generalized stimulation of the immune system. The co-protein may be attached to either the amino or carboxy terminus of the first protein.

Also provided by this invention are methods using the nucleic acid molecule according to the present invention in their diverse embodiments in such genetic immunization experiments in animal models of infection with any of the *Klebsiella* species described herein, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. Such molecules will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of the *Klebsiella* species described herein and especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*, infection in mammals, particularly humans.

The polypeptides according to the present invention in their diverse embodiments may be used as an antigen for vaccination of a host to produce specific antibodies which protect against invasion of bacteria, for example by blocking adherence of bacteria to damaged tissue. Examples of tissue damage and thus damaged tissue include wounds in skin or connective tissue and mucosal tissues caused e.g. by viral infection (esp. respiratory, such as the flu) mechanical, chemical or thermal damage or by implantation of indwelling devices, or wounds in the mucous membranes, such as the mouth, mammary glands, urethra or vagina.

The present invention also includes a vaccine formulation, which comprises one or several of polypeptides according to the present invention in their diverse embodiments together with one or more suitable carriers and/or excipients. The pharmaceutically acceptable carriers and/or excipients useful in this invention are conventional and may include buffers, stabilizers, diluents, preservatives, and solubilizers. Remington's Pharmaceutical Sciences, by E. W. Martin, Mack Publishing Co., Easton, Pa., 15th Edition (1975), describes compositions and formulations suitable for pharmaceutical delivery of the (poly)peptides herein disclosed. In general, the nature of the carrier or excipients will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g. powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Since said polypeptides according to the present invention may be broken down in the stomach, they are preferably administered parenterally, including, for example, administration that is subcutaneous, intramuscular, intravenous, intradermal, intranasal or transdermal. Formulations suitable for parenteral administration include aqueous and non-aqueous sterile injection solutions which may contain anti-oxidants, buffers, bacteriostats and solutes which render the formulation isotonic with the body fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising one or several of the polypeptides according to the present invention in their diverse embodiments for the various *Klebsiella* species described herein and especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. Such a pharmaceutical composition may comprise one, preferably at least two or more of said polypeptides against said *Klebsiella* species. Optionally, such polypeptides may also be combined with antigens against even further pathogens in a combination pharmaceutical composition. Preferably, said pharmaceutical composition is a vaccine for preventing or treating an infection caused by a *Klebsiella* species, more preferably a pathogenic *Klebsiella* species such as *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca* and/or other pathogens against which the antigens have been included in the vaccine.

According to a further aspect, the present invention relates to a pharmaceutical composition comprising a nucleic acid molecule according to the present invention. Such a pharmaceutical composition may comprise one or more nucleic acid molecules according to the present invention encoding a polypeptide according to the present invention. Optionally, such nucleic acid molecules encoding the polypeptides according to the present invention are combined with nucleic acid molecules encoding antigens against other pathogens in a combination pharmaceutical composition. Preferably, said pharmaceutical composition is a vaccine for preventing or treating an infection caused by *Klebsiella* species, more preferably pathogenic *Klebsiella* species as disclosed herein, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*, and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

In a preferred embodiment the pharmaceutical composition further comprises an immunostimulatory substance such as an adjuvant. The adjuvant can be selected based on the method of administration and may include polycationic substances, especially polycationic peptides, immunostimulatory nucleic acids molecules, preferably immunostimulatory oligo-deoxynucleotides (ODNs), especially Oligo(dIdC)$_{13}$, peptides containing at least two LysLeuLys motifs, especially peptide KLKLLLLLKLK (SEQ IN NO: 766), alum, mineral oil-based adjuvants such as Freund's complete adjuvant and Freund's incomplete adjuvant, neuroactive compounds, especially human growth hormone, or any combination of one or more of the above mentioned adjuvants. Other suitable adjuvants may be selected from the group consisting of Montanide incomplete Seppic adjuvant such as ISA, oil in water emulsion adjuvants such as the Ribi adjuvant system, syntax adjuvant formulation containing muramyl dipeptide, or aluminum salt adjuvants or combinations thereof. Preferably, the adjuvant is IC31® (Intercell; a synthetic adjuvant comprising the peptide motif KLK as described in WO 02/32451 and an oligonucleotide as described in WO 01/93905).

The term "Oligo(dIdC)$_{13}$" as used in the present invention means a phosphodiester substituted single-stranded ODN containing 13 deoxy (inosine-cytosine) motifs, also defined by the term [oligo-d(IC)$_{13}$]. The exact sequence is 5'-dIdC-dIdCdIdCdIdCdIdCdIdCdIdC-dIdCdIdCdIdCdIdCdIdC-3'(SEQ ID NO: 767). Oligo(dIdC)$_{13}$ can also be defined by the terms (oligo-dIC$_{26}$); oligo-dIC2$_{6-mer}$; oligo-deoxy IC, 26-mer; or oligo-dIC, 26-mer, as specified for example in WO 01/93903 and WO 01/93905.

It is also within the scope of the present invention that the pharmaceutical composition, especially vaccine, comprises apart from one or several of he polypeptides according to the present invention in their diverse embodiments and/or nucleic acid molecules coding thereof which are also in accordance with the present invention, other compounds which are biologically or pharmaceutically active. Preferably, the vaccine composition comprises at least one polycationic peptide. The polycationic compound(s) to be used according to the present invention may be any polycationic compound, which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in (Ganz, T., 1999). These (poly)peptides may be of prokaryotic or animal or plant origin or may be produced chemically or recombinantly (WO 02/13857). Peptides may also belong to the class of defensins (WO 02/13857). Sequences of such peptides can be, for example, found in the Antimicrobial Sequences Database at the University of Trieste,Italy.

Such host defence peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammalian cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide, which has the amino acid sequence $NH_2$-RLAGLL-RKGGEKIGEKLKKIGOKIKNFFQKLVPQPE-COOH (SEQ ID NO: 768). Related or derived cathelin substances contain the whole or parts of the cathelin sequence with at least 15-20 amino acid residues. Derivations may include the substitution or modification of the natural amino acids by amino acids, which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunactivating substances.

Another preferred polycationic substance to be used in accordance with the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxyuridine residues (described in WO 01/93905 and WO 02/095027, incorporated herein by reference) may preferably be used as immunostimulatory nucleic acids in connection with the present invention. Preferably, the mixtures of different immunostimulatory nucleic acids may be used according to the present invention.

It is also within the present invention that any of the aforementioned polycationic compounds is combined with any of the immunostimulatory nucleic acids as aforementioned. Preferably, such combinations are according to the ones as described in WO 01/93905, WO 02/32451, WO 01/54720, WO 01/93903, WO 02/13857, WO 02/095027 and WO 03/047602, incorporated herein by reference.

In addition or alternatively such vaccine composition may comprise apart from the polypeptides according to the present invention, and the nucleic acid molecules according to the present invention, preferably the coding nucleic acid molecules according to the present invention, a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

Also, the pharmaceutical composition in accordance with the present invention is a pharmaceutical composition which comprises at least any of the following compounds or combinations thereof: the nucleic acid molecules according to the present invention, the polypeptides according to the present invention in their diverse embodiments, the vector according to the present invention, the cells according to the present invention, the antibody according to the present invention, the functional nucleic acids according to the present invention and the binding peptides such as the anticalines and high-affinity binding peptides and peptide aptamers, respectively, according to the present invention, any agonists and antagonists according to the present invention, preferably screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of an antigen and fragments thereof of the invention and a pharmaceutically acceptable carrier or excipient. Such carriers may include, but are not limited to, saline, buffered saline, dextrose, water, glycerol, ethanol and combinations thereof. The formulation should suit the mode of administration.

The composition may be used e.g. for immunization or treatment of a subject. The pharmaceutical composition encompasses at least one peptide of the invention; however, it may also contain a cocktail (i.e., a simple mixture) containing different peptides (including fragments and other variants) of the invention, optionally mixed with different antigenic proteins or peptides of other pathogens. Such mixtures of these peptides, polypeptides, proteins or fragments or variants thereof are useful e.g. in the generation of desired antibodies to a wide spectrum of *Klebsiella* isolates. The peptide(s) of the present invention may also be used in the form of a pharmaceutically acceptable salt. Suitable acids and bases which are capable of forming salts with the peptides of the present invention are well known to those of skill in the art, and include inorganic and organic acids and bases.

Still another aspect of the present invention is a pharmaceutical composition containing a nucleic acid selected from the group consisting of:
(i) a nucleic acid of the invention and/or a nucleic acid complementary thereto, and
(ii) optionally a pharmaceutically acceptable carrier or excipient.

The nucleic acid sequences, alone or in combination with other nucleic acid sequences encoding antigens or antibodies or directed to other pathogenic microorganisms, may further be used as components of a pharmaceutical composition. The composition may be used for immunizing or treating humans and/or animals with the disease caused by infection with *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. The pharmaceutically acceptable carrier or excipient may be as defined above.

In another embodiment, the nucleic acid sequences of this invention, alone or in combination with nucleic acid sequences encoding other antigens or antibodies from other pathogenic microorganisms, may further be used in compositions directed to actively induce a protective immune response to the pathogen in a subject. These components of the present invention are useful in methods for inducing a protective immune response in humans and/or animals against infection with *Klebsiella*, preferably *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

For use in the preparation of the therapeutic or vaccine compositions, nucleic acid delivery compositions and methods are useful, which are known to those of skill in the art. The nucleic acid of the invention may be employed in the methods of this invention or in the compositions described herein as DNA sequences, either administered as naked DNA, or associated with a pharmaceutically acceptable carrier and provide for in vivo expression of the antigen, peptide or polypeptide. So-called "naked DNA" may be used to express the antigen, peptide or polypeptide of the invention in vivo in a patient. (See, e.g., Cohen, J., 1993, which describes similar uses of "naked DNA"). For example, "naked DNA" associated with regulatory sequences may be administered therapeutically or as part of the vaccine composition e.g., by injection.

Alternatively, a nucleic acid encoding the antigens or peptides of the invention or a nucleic acid complementary thereto may be used within a pharmaceutical composition, e.g. in order to express the antigens or peptides or polypeptides of the invention in vivo, e.g., to induce antibodies.

A preferred embodiment of the invention relates to a pharmaceutical composition, wherein the nucleic acid according to the invention is comprised in a vector and/or a cell. Vectors and cells suitable in the context of the present invention are described above. Vectors are particularly employed for a DNA vaccine. An appropriate vector for delivery may be readily selected by one of skill in the art. Exemplary vectors for in vivo gene delivery are readily available from a variety of academic and commercial sources, and include, e.g., adeno-associated virus (International patent application No. PCT/US91/03440), adenovirus vectors (Kay, M. et al., 1994; Ishibashi, S. et al., 1993), or other viral vectors, e.g., various poxviruses, vaccinia, etc. Recombinant viral vectors, such as retroviruses or adenoviruses, are preferred for integrating the exogenous DNA into the chromosome of the cell.

The pharmaceutical compositions of the present invention may be administered in any effective, convenient manner including, for instance, administration by topical, oral, anal, vaginal, intravenous, intraperitoneal, intramuscular, subcutaneous, intranasal, intratracheal or intradermal routes among others.

In therapy or as a prophylactic, the active agent of the pharmaceutical composition of the present invention may be administered to an individual as an injectable composition, for example as a sterile aqueous dispersion, preferably isotonic.

Alternatively the composition, preferably the pharmaceutical composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

In a preferred embodiment the pharmaceutical composition is a vaccine composition. Preferably, such vaccine composition is conveniently in injectable form. Conventional adjuvants may be employed to enhance the immune response. A suitable unit dose for vaccination with a protein antigen is for adults between 0.02 to 3 µg antigen/per kg of body weight and for children between 0.2 to 10 µg antigen/per kg body weight, and such dose is preferably administered 1-3 times and with an interval of 2 to 24 weeks.

An "effective amount" or "therapeutically effective amount" of an antigen, nucleic acid, vector, an antibody or a pharmaceutical composition of the invention may be calculated as that amount capable of exhibiting an in vivo effect, e.g. preventing or ameliorating a sign or symptom of infection with *Klebsiella*, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. Such amounts may be determined by one of skill in the art.

With the indicated dose range, no adverse toxicological effects are expected with the compounds of the invention, which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the preparation, use or sale of pharmaceuticals or biological products, reflecting approval by the agency of the preparation, use or sale of the product for human administration.

In connection with the present invention any disease related use as disclosed herein such as, e.g., use of the pharmaceutical composition or vaccine, is particularly a disease or diseased condition which is caused by, linked or associated with *Klebsiella*, more preferably any pathogenic *Klebsiella* species and especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*. A disease related, caused or associated with the bacterial infection to be prevented and/or treated according to the present invention includes nosocomial infections. Common sites include the urinary tract, lower respiratory tract, biliary tract, and surgical wound sites. The spectrum of clinical syndromes includes pneumonia, bacteraemia, thrombophlebitis, urinary tract infection (UTI), cholecystitis, diarrhea, upper respiratory tract infection, wound infection, osteomyelitis, and meningitis.

It is within the present invention that each and any of the symptoms, diseases, disorders or syndromes described herein which are either directly or indirectly linked to or arise from a contact of an organism such as any animal or human with a *Klebsiella* species, more preferably a pathogenic *Klebsiella* species, and especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca* are separately and independently indications, diseases or disorders in the meaning of the present invention. Accordingly and just by means of illustration, a disease in the sense of the present application is septicaemia as well as meningitis and osteomyelitis.

It is within the present invention that the disease for which the various compounds described herein can be used are also those diseases where the polypeptide according to the present invention is expressed or any disease where the compounds described herein such as the polypeptides according to the present invention, the vaccine, the antibody, and any aptamer and spiegelmer, respectively, are suitable for the treatment and/or diagnosis thereof. Such potential use can arise from cross-reactivity and homology, respectively. It understood by the one skilled in the art that any disease described in connection with the pharmaceutical composition according to the present invention can be subject to the use of the pharmaceutical composition described herein, and vice versa.

Treatment in the context of the present invention refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

In a still further embodiment the present invention is related to a screening method using any of the polypeptides according to the present invention or any of the nucleic acids according to the present invention. Screening methods as such are known to the one skilled in the art and can be designed such that an agonist or an antagonist is screened. In connection with such screening method preferably an antagonist is screened which in the present case inhibits or prevents the binding of any antigen and fragment thereof according to the present invention to an interaction partner. Such interaction partner can be a naturally occurring interaction partner or a non-naturally occurring interaction partner.

The invention also provides a method for screening compounds to identify those, which enhance (agonist) or block (antagonist) the function of the polypeptides according to the present invention or of the nucleic acid molecules of the present invention, such as its interaction with a binding molecule. The method of screening may involve high-throughput.

For example, to screen for agonists or antagonists, the interaction partner of the nucleic acid molecule and nucleic acid, respectively, according to the present invention, maybe a synthetic reaction mix, a cellular compartment, such as a membrane, cell envelope or cell wall, or a preparation of any thereof, may be prepared from a cell that expresses a molecule that binds to the polypeptides according to the present invention. The preparation is incubated with labelled forms of such polypeptides in the absence or the presence of a candidate molecule, which may be an agonist or antagonist. The ability of the candidate molecule to bind the binding molecule is reflected in decreased binding of the labelled ligand. Molecules which bind gratuitously, i.e., without inducing the functional effects of said polypeptides, are most likely to be good antagonists. Molecules that bind well and elicit functional effects that are the same as or closely related to the polypeptides according to the present invention are good agonists.

The functional effects of potential agonists and antagonists may be measured, for instance, by determining the activity of a reporter system following interaction of the candidate molecule with a cell or appropriate cell preparation, and comparing the effect with that of polypeptides according to the present invention or molecules that elicit the same effects as said polypeptides. Reporter systems that may be useful in this regard include but are not limited to colorimetric labelled substrate converted into product, a reporter gene that is responsive to changes in the functional activity of the polypeptides according to the present invention, and binding assays known in the art.

Another example of an assay for antagonists is a competitive assay that combines the polypeptides according to the present invention and a potential antagonist with membrane-bound binding molecules, recombinant binding molecules, natural substrates or ligands, or substrate or ligand mimetics, under appropriate conditions for a competitive inhibition assay. The polypeptides according to the present invention can be labelled such as by radioactivity or a colorimetric compound, such that the molecule number of polypeptides according to the present invention bound to a binding molecule or converted to product can be determined accurately to assess the effectiveness of the potential antagonist.

Potential antagonists include small organic molecules, peptides, polypeptides and antibodies that bind to polypeptides according to the present invention and thereby inhibit or extinguish its activity. Potential antagonists may also be small organic molecules, a peptide, a polypeptide such as a closely related protein or antibody that binds to the same sites on a binding molecule without inducing functional activity of the polypeptides according to the present invention.

Potential antagonists include a small molecule, which binds to and occupies the binding site of the polypeptides according to the present invention thereby preventing binding to cellular binding molecules, such that normal biological activity is prevented. Examples of small molecules include but are not limited to small organic molecules, peptides or peptide-like molecules.

Other potential antagonists include antisense molecules (see (Okano, H. et al., 1991); OLIGODEOXYNUCLE-OTIDES AS ANTISENSE INHIBITORS OF GENE EXPRESSION; CRC Press, Boca Raton, Fla. (1988), for a description of these molecules).

Preferred potential antagonists include derivatives of the antigens and fragments thereof of the invention.

As used herein the activity of a polypeptide according to the present invention is its capability to bind to any of its interaction partner or the extent of such capability to bind to its or any interaction partner.

In a particular aspect, the invention provides the use of the polypeptides according to the present invention antigens and fragments thereof, nucleic acid molecules or inhibitors of the invention to interfere with the initial physical interaction between a pathogen and mammalian host responsible for sequelae of infection. In particular the molecules of the invention may be used: i) in the prevention of adhesion of the *Klebsiella* species as disclosed herein and more preferably the pathogenic species thereof, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca* to mammalian extracellular matrix proteins; ii) to block bacterial adhesion between mammalian extracellular matrix proteins and bacterial proteins which mediate tissue reaction; iii) or lead to evasion of immune defence; iv) to block the normal progression of pathogenesis in infections initiated other than by the implantation of in-dwelling devices or by other surgical techniques, e.g. through inhibiting nutrient acquisition.

Each of the DNA coding sequences provided herein may be used in the discovery, development and/or preparation of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with *Klebsiella* species, especially *K. pneumoniae* including the three subspecies *pneumoniae, ozaenae* and *rhinoscleromatis, K. oxytoca, K. planticola, K. terrigena*, and *K. ornithinolytica*, and more preferably from *K. pneumoniae* or *K. oxytoca*.

In a still further aspect the present invention is related to an affinity device such affinity device comprises as least a support material and any of the polypeptides according to the present invention, which is attached to the support material. Because of the specificity of said polypeptides for their target cells or target molecules or their interaction partners, said polypeptides allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The polypeptides according to the present invention may be attached to the matrix in a covalent or non-covalent manner. Suitable support material is known to the one skilled in the art and can be selected from the group comprising cellulose, silicon, glass, aluminium, paramagnetic beads, starch and dextrane.

The present invention is further illustrated by the following Figures, Tables, Examples and the Sequence Listing, from which further features, embodiments and advantages may be taken. It is to be understood that the present examples are given by way of illustration only and not by way of limitation of the disclosure.

In connection with the present invention

Table 1 shows the summary of all screens performed with genomic *K. pneumoniae* libraries and human serum.

Table 2 shows the strains used for gene distribution analysis.

Table 3 shows the summary of the gene distribution analysis for a selected number of antigens in various strains of the respective bacterial species.

Table 4 shows the summary of the peptide ELISA with human sera.

Table 5 Surface staining with epitope sera generated in mice.

Table 6 shows independent *Klebsiella* sp. isolates used to amplify genes of interest.

Table 7 shows the sequences of the oligonucleotides used to amplify genes of interest.

Table 8 Gene conservation of KPORF-13.
Table 9 Gene conservation of KPORF-21.
Table 10 Gene conservation of KPORF-32.
Table 11 Gene conservation of KPORF-37.
Table 12 Gene conservation of KPORF-38.
Table 13 Gene conservation of KPORF-39.
Table 14 Gene conservation of KPORF-60.
Table 15 Gene conservation of KPORF-65.
Table 16 Antigen fragments used for protection experiments.

The figures and tables to which it might be referred to in the specification are described in the following in more details.

Figure 1A:
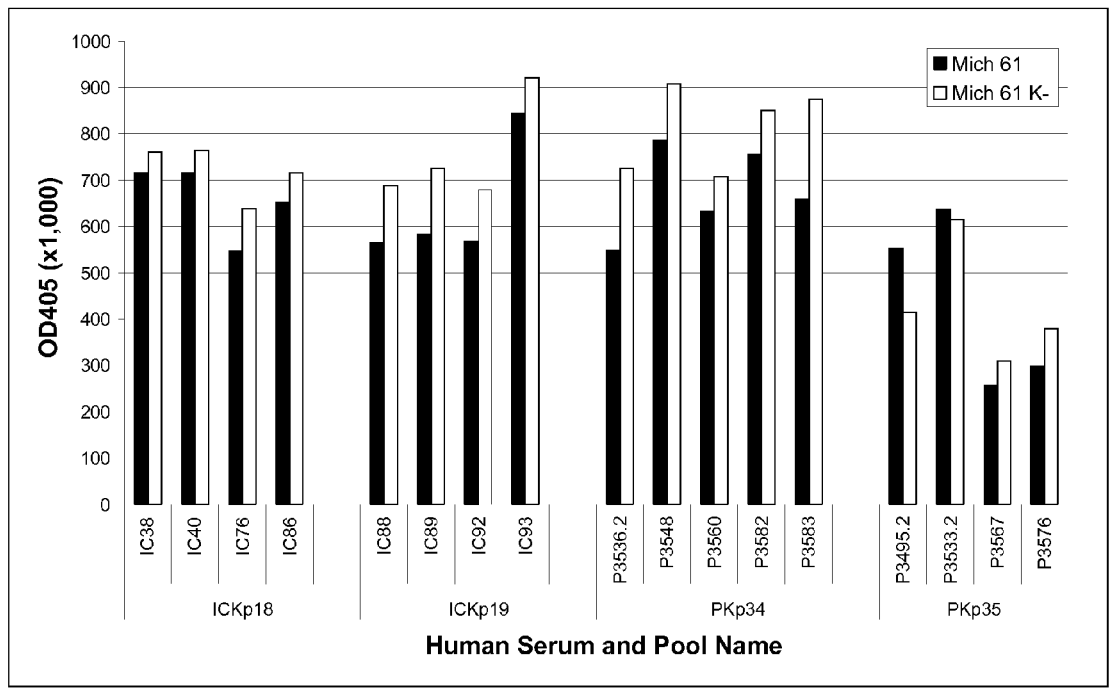
FIG. 1 shows the characterization of human sera as sources of pathogen specific antibodies.
Figure 1B:
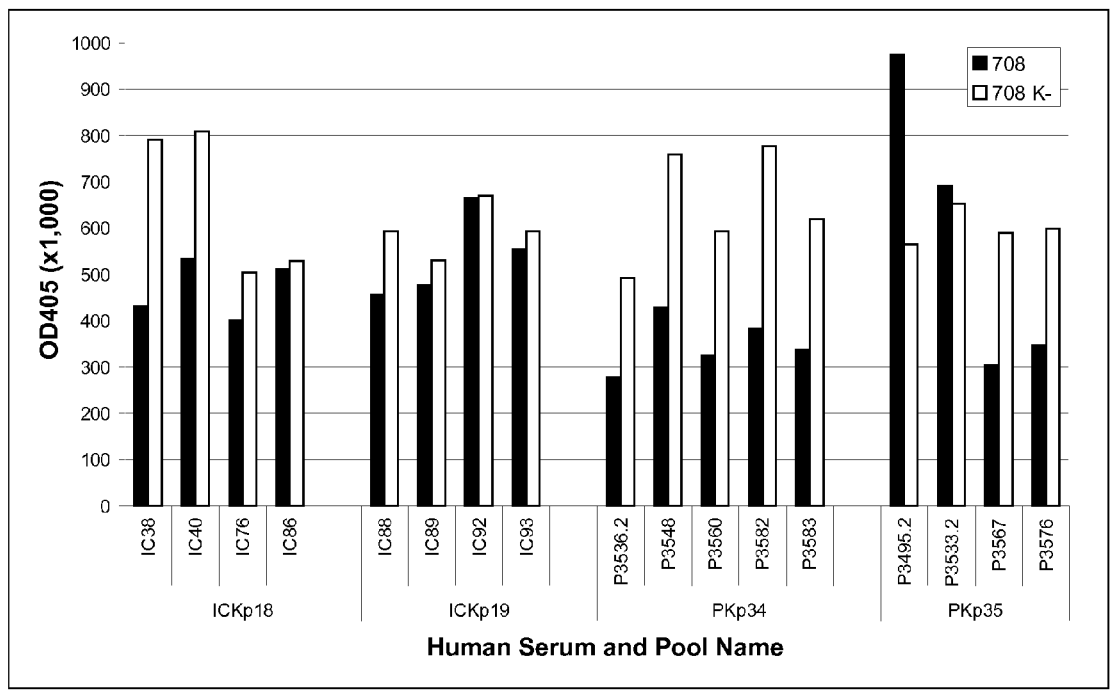

FIG. 1 shows the characterization of human sera by measuring antibodies specific for *K. pneumoniae* by immune assays. Total IgG antibody levels were measured by standard ELISA. (A) total bacterial lysates prepared from *K. pneumoniae* strain Mich 61 and its respective capsule negative mutant. (B) total bacterial lysates prepared from *K. pneumoniae* strain 708 and its respective capsule negative mutant. Serum samples from healthy individuals and patients with septicaemia were analyzed at two different serum dilutions (1:1,000 and 1:5,000). P3536.2, P3495.2 and P3533.2 were convalescent sera obtained from patients after recovering from sickness. Results of the sera selected for the four different pools at a serum dilution of 1:1,000 are shown.

FIG. 2 (A) shows the fragment size distribution of the *K. pneumoniae* small fragment genomic library, KPL50 in pMAL4.31. After sequencing randomly selected clones, sequences were trimmed (476) to eliminate vector residues and the numbers of clones with various genomic fragment sizes were plotted. (B) shows the fragment size distribution of the *K. pneumoniae* large fragment genomic library, KPF300 in pMAL4.31. Sequences of randomly selected clones were trimmed (425) and the numbers of clones with various genomic fragment sizes were plotted.

FIG. 3 (A) shows the MACS selection with the biotinylated human IgG pool with sera from patients with septicaemia. The KPL50 library in pMAL9.1 was screened with 10-20 μg biotinylated IgG. As negative control, no serum was added to the library cells for screening. Number of cells selected after elution are shown. (B) shows the reactivity of specific clones (1-20) selected by bacterial surface display and Wt (pMAL9.1 without insert) as analyzed by immunoblot analysis with the human serum IgG pool (PKp34-IgG) used for selection by MACS at a dilution of 1:3,000. Asterisks indicate the clones detected as positive. As a loading control the same blot was also analyzed with antibodies directed against the platform protein LamB at a dilution of 1:5,000 (data not shown). (C) shows the MACS selection with the biotinylated human IgG pool with sera from patients with septicaemia (PKp35-IgG) and the KPF300 library in pHIE11. (D) shows the reactivity of specific clones (1-20) selected by bacterial surface display and Wt (pHIE11 without insert) as analyzed by immunoblot analysis with the human serum IgG pool (PKp35-IgG) used for selection by MACS at a dilution of 1:3,000. Asterisks indicate the clones detected as positive.

Figure 4:
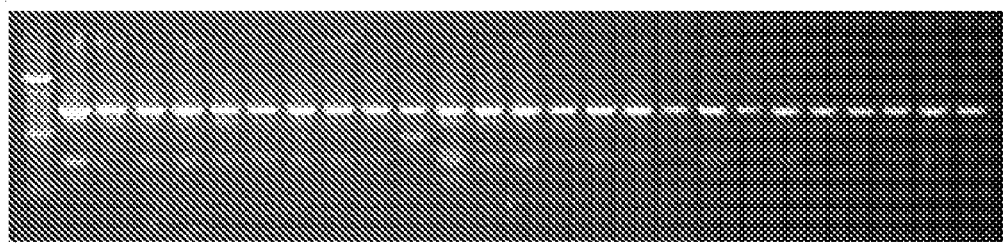
FIG. 4 shows the PCR analysis to determine the gene distribution of a selected antigen in clinical isolates of the respective bacterial pathogen.
Figure 4:

FIG. 4 shows an example for the PCR analysis for the gene distribution analysis of one gene with the respective oligonucleotides and 46 *K. pneumoniae* strains. The predicted size of the PCR fragment derived from antigen KPORF-54 from *K. pneumoniae* is 1040 bp. 1-46: strains or clinical isolates as shown in Table 2; –: no genomic DNA; +: genomic DNA of *K. pneumoniae* strain MGH78578.

Figure 5:
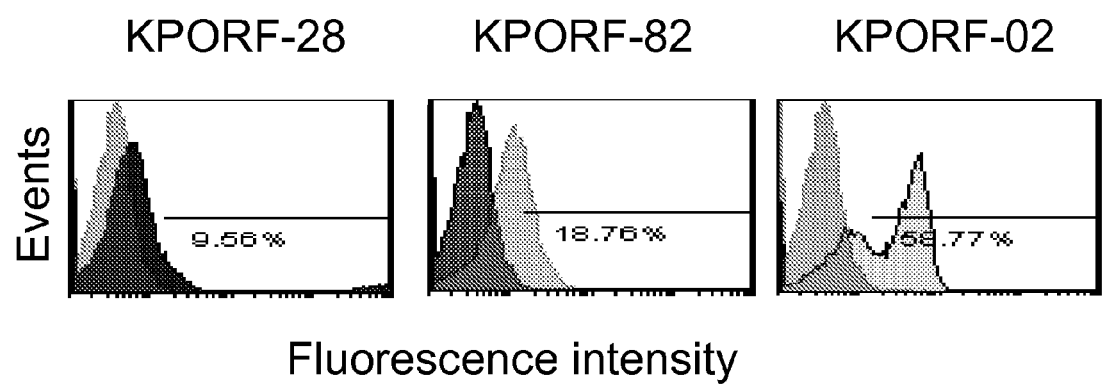
FIG. 5 shows examples for surface staining with epitope sera generated in mice.

FIG. 5 shows examples for surface staining with epitope sera generated in mice. Efficient surface display of three antigens on *K. pneumoniae* A5054 is shown. KPORF-28, KPORF-82 and KPORF-02 are examples for category "+", 0-9%; "++", 10-35% and "+++", >36%. Percentage indicates the number of cells that showed a shift in the FACS analysis in comparison to cells incubated without immune sera.

FIGS. 6 (A), (B), (C), (D) and (E) show the protection achieved by active immunization with selected *K. pneumoniae* antigens in a mouse lethality model. CD-1 mice (10 mice per group) were immunized subcutaneously with recombinant antigens cloned from a *K. pneumoniae* strain MHG78578 and challenged with *K. pneumoniae* (O1:K2) strain B5055. Survival was monitored for 14 days post-challenge. Mice were immunized subcutaneously with 50 μg recombinant protein adjuvanted with CFA/IFA or IFA. Mice immunized with PBS combined with CFA/IFA or IFA were used as negative controls, while mice immunized with *K. pneumoniae* B5055 lysate (5 μg) served as a positive control. Mice were challenged intraperitoneally with $10^3$ CFU *K. pneumoniae* B5055. Numbers of surviving mice are plotted as percentage of total mice.

Figure 7A:
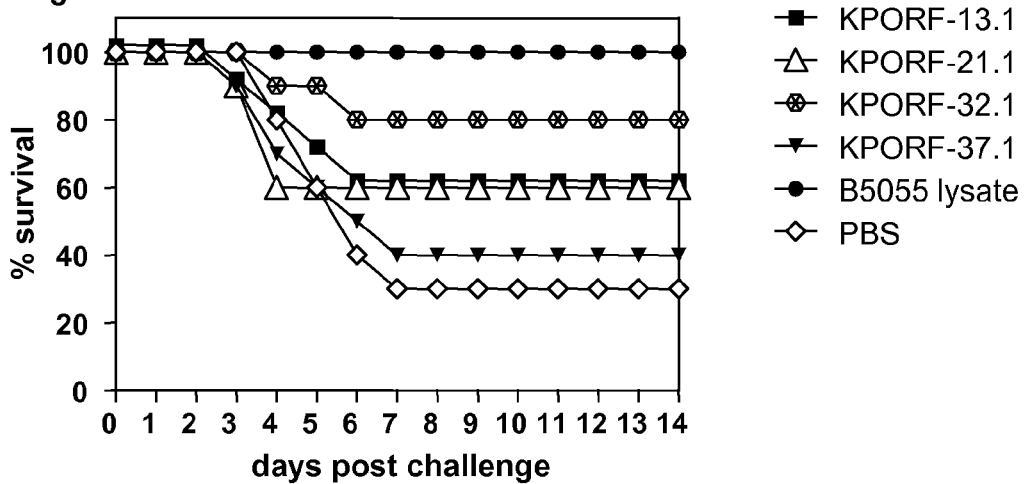
FIG. 7 shows the protection conferred by active immunization with selected *K. pneumoniae* antigens in a mouse lethality model, when Alum was used as adjuvant.

FIGS. 7 (A) and (B) show the protection conferred by active immunization with selected *K. pneumoniae* antigens in a mouse lethality model. CD-1 mice (10 mice per group) were immunized subcutaneously with recombinant antigens cloned from a *K. pneumoniae* strain MHG78578 and challenged with *K. pneumoniae* (O1:K2) strain B5055. Survival was monitored for 14 days post-challenge. Mice were immunized subcutaneously with 50 μg recombinant protein adjuvanted with Alum. Mice immunized with PBS combined with Alum were used as negative controls, while mice immunized with *K. pneumoniae* B5055 lysate (5 μg) combined with Alum served as a positive control. Mice were challenged intraperitoneally with $10^3$ CFU *K. pneumoniae* B5055. Numbers of surviving mice are plotted as a percentage of total mice.

Figure 8A:
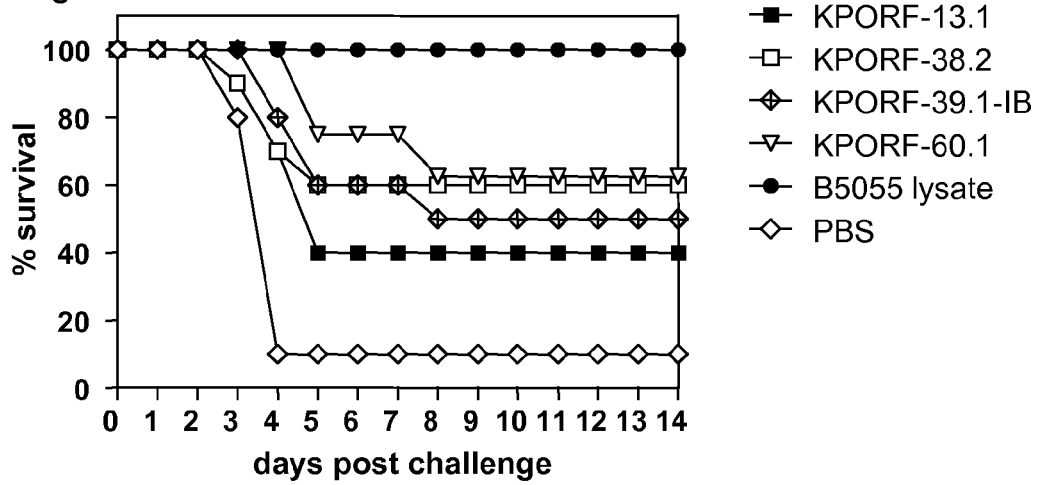
FIG. 8 shows the protection conferred by active immunization with selected *K. pneumoniae* antigens in a mouse lethality model, when IC31® was used as adjuvant.
Figure 8B:
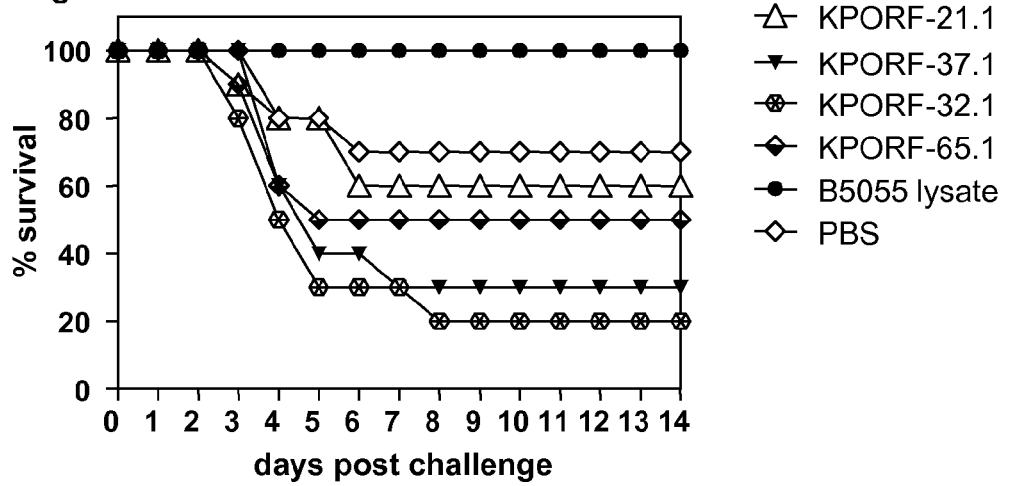

FIGS. 8 (A) and (B) show the protection conferred by active immunization with selected *K. pneumoniae* antigens in a mouse lethality model. CD-1 mice (10 mice per group) were immunized subcutaneously with recombinant antigens cloned from a *K. pneumoniae* strain MHG78578 and challenged with *K. pneumoniae* (O1:K2) strain B5055. Survival was monitored for 14 days post-challenge. Mice were immunized subcutaneously with 50 μg recombinant protein adjuvanted with IC31®. Mice immunized with PBS combined with IC31® were used as negative controls, while mice immunized with *K. pneumoniae* B5055 lysate (5 μg) combined with IC31® served as a positive control. Mice were challenged intraperitoneally with $10^3$ CFU *K. pneumoniae* B5055. Numbers of surviving mice are plotted as a percentage of total mice.

Figure 9A:
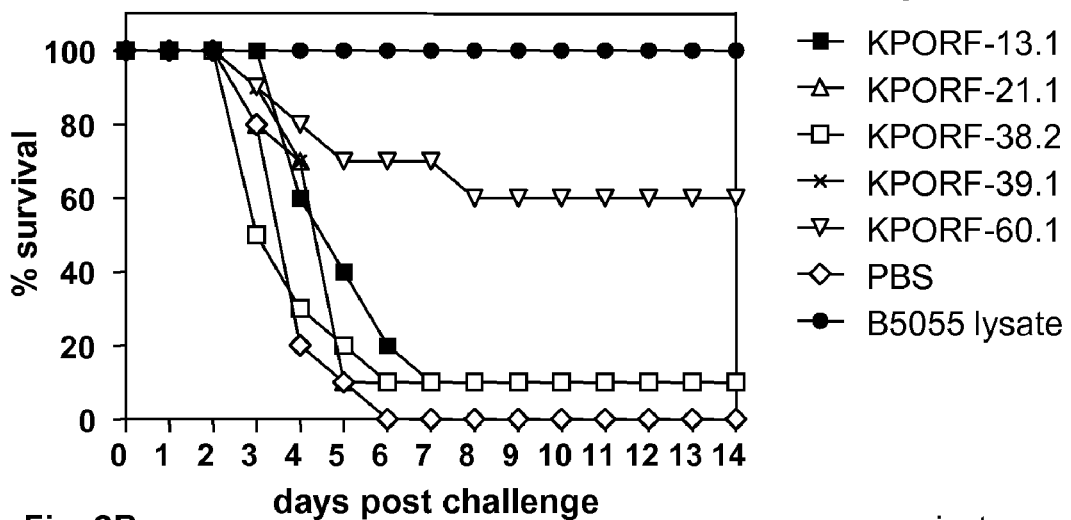
FIG. 9 shows the protection conferred by passive immunization with polyclonal rabbit sera raised against selected *K. pneumoniae* antigens in a mouse lethality model.

FIGS. 9 (A) and (B) show the protection conferred by passive immunization with polyclonal rabbit sera raised against selected *K. pneumoniae* antigens in a mouse lethality model. CD-1 mice (10 mice per group) were immunized intraperitoneally with sera raised against recombinant antigens cloned from a *K. pneumoniae* strain MHG78578 and challenged with *K. pneumoniae* (O1:K2) strain B5055. Survival was monitored for 14 days post-challenge. Mice immunized with PBS sera were used as negative controls, while mice immunized with *K. pneumoniae* B5055 lysate sera (5 μg) served as a positive control. Mice were challenged intraperitoneally with $10^3$ CFU *K. pneumoniae* B5055. Numbers of surviving mice are plotted as a percentage of total mice.

TABLE 1

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPORF-01 | NADH pyrophosphatase | 11-27, 35-47, 68-107, 113-122, 124-136, 140-146, 152-164, 168-174, 183-201, 211-218, 228-243, 246-253 | 2 | H | 180-226 | 17, 204 |
| KPORF-02 | Lactoylglutathione lyase and related lyases | 13-31, 48-59, 69-91, 109-115, 121-127 | 2 | D | 46-105 | 18, 205 |
| KPORF-03 | ABC-type Fe3+ transport system, permease component | 12-44, 49-95, 102-145, 148-178, 184-229, 233-244, 249-273, | 3 | A | 273-286 | 19, 206 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 292-299, 304-329, 334-348, 354-365, 367-385, 394-426, 428-440, 444-487, 503-527, 531-539, 546-554, 556-584 | | | | |
| KPORF-04 | Hypothetical transcriptional activator | 7-17, 22-32, 34-41, 55-77, 79-86, 93-111, 118-126, 131-148, 152-162, 165-177, 183-197, 213-220, 234-250, 253-262, 267-294 | 2 | G | 211-269 | 20, 207 |
| KPORF-05 | 23S rRNA pseudouridylate synthase | 22-29, 41-56, 58-66, 79-88, 94-121, 124-131, 134-157, 162-171, 173-180, 189-197, 201-214, 216-224, 242-254, 257-270, 282-287, 290-302, 309-315, 320-325, 341-355, 362-368, 372-378 | 3 | H | 1-48 | 21, 208 |
| KPORF-06 | Glucosyltransferase MdoH | 5-15, 18-35, 48-61, 65-71, 112-119, 138-154, 157-169, 179-208, 214-223, 226-232, 243-250, 256-262, 277-286, 289-296, 338-348, 352-363, 370-376, 385-408, 420-436, 443-454, 462-483, 498-561, 563-592, 600-642, 661-671, 673-709, 714-733, 748-754, 771-776, 798-806, 808-821, 823-839 | 2 | C | 31-83 | 22, 209 |
| KPORF-07 | trp-repressor binding protein | 5-14, 21-26, 31-41, 59-77, 101-115, 132-145, 147-156, 180-185, 188-197 | 3 | H | 97-158 | 23, 210 |
| KPORF-08 | Putative transcriptional regulator | 6-18, 23-43, 45-56, 69-80, 87-97, 112-123, 135-151, 164-171, 178-193, 200-227, 249-258, 262-274, 279-291, 302-308, 322-327, 329-336, 351-363, 366-373, 384-399, 403-411, 415-434, 440-446, 461-482, 488-506, 510-516, 518-551, 574-589, 607-629, 634-665, 667-687, 694-712, 725-739, 743-751, 753-768 | 2 | G | 521-583 | 24, 211 |
| KPORF-09 | Zinc-containing alcohol dehydrogenase | 4-13, 19-44, 55-63, 71-82, 89-110, 120-130, 132-138, 145-161, 168-182, 189-258, 261-272, 278-288, 290-301 | 3 | G | 11-76 | 25, 212 |
| KPORF-10 | Putative inner membrane protein | 4-22, 43-56, 63-68, 81-90, 93-99, 139-148, 155-160, 170-176, 189-195, 207-218, 227-232, 241-249, 251-258, 260-266, 277-295, 300-327, 329-336, 340-356, | 2 | D | 383-428 | 26, 213 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 384-390, 418-423, 427-433, 438-444 | | | | |
| KPORF-11 | Putative nucleotide-utilizing enzyme related to molybdopterin-biosynthesis | 10-18, 32-37, 45-55, 60-69, 77-83, 89-95, 120-125, 133-170, 172-185, 193-211, 214-223, 232-249, 255-275, 277-303, 305-310, 320-328, 334-341, 347-353, 355-369, 380-386, 389-395 | 8 | E | 71-85 | 27, 214 |
| KPORF-12 | ABC transporter ATP-binding protein | 4-23, 27-35, 67-73, 80-103, 117-126, 132-138, 140-159, 162-171, 180-194, 198-208, 211-218, 228-234, 239-253, 262-270, 272-291, 296-305 | 2 | D | 39-110 | 28, 215 |
| KPORF-13 | Periplasmic glycerophosphodiester phosphodiesterase | 13-24, 27-34, 37-66, 69-88, 99-104, 149-155, 164-175, 184-193, 199-209, 227-235, 264-273, 276-285, 288-315, 323-335, 346-353 | 4 | D | 56-111, 199-261 | 29, 216 |
| KPORF-14 | Glucosamine-fructose-6-phosphate aminotransferase | 11-22, 25-48, 51-60, 64-72, 80-96, 108-122, 132-137, 142-150, 152-167, 175-199, 214-229, 237-244, 252-258, 260-266, 279-287, 301-340, 345-350 | 2 | G | 109-153 | 30, 217 |
| KPORF-15 | Isoleucine tRNA synthetase | 37-43, 50-57, 65-82, 87-109, 123-129, 141-150, 152-157, 166-172, 179-203, 209-241, 249-284, 290-300, 308-326, 329-335, 345-357, 359-368, 379-386, 390-417, 420-425, 438-444, 461-466, 473-490, 497-505, 524-534, 541-550, 586-597, 608-614, 622-632, 660-666, 679-694, 696-706, 708-722, 725-731, 737-763, 784-789, 810-825, 837-854, 857-880, 882-895, 901-907, 911-928 | 3 | G | 14-76, 176-220 | 31, 218 |
| KPORF-16 | Putative oxidoreductase | 9-16, 38-52, 61-86, 93-100, 110-117, 123-132, 138-145, 151-169, 172-181, 186-202, 208-225, 227-253, 264-275, 289-295, 320-329, 335-342 | 5 | H | 113-193 | 32, 219 |
| KPORF-17 | Putative molybdopterin oxidoreductases | 11-18, 24-30, 42-49, 53-63, 69-80, 87-93, 95-103, 144-171, 173-185, 193-200, 202-208, 215-221, 242-261, 266-273, 277-286, 290-299, 322-328, 338-351, 354-377, 391-409, 441-451, 461-466, | 2 | H | 490-547 | 33, 220 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 499-515, 521-527, 562-569, 621-629, 647-663, 676-682, 694-701, 703-713, 725-731, 735-744, 755-764, 793-800 | | | | |
| KPORF-18 | Putative penicillin-binding protein | 4-11, 14-22, 38-70, 81-90, 97-114, 118-132, 147-171, 173-181, 187-202, 244-250, 252-298, 301-311, 313-331, 342-368, 410-418, 446-451, 456-462, 468-474, 476-492, 499-507, 519-528, 552-565, 568-575, 584-613, 618-624, 626-649 | 4 | C | 417-489 | 34, 221 |
| KPORF-19 | Putative secretion protein (Multidrug resistance efflux pump) | 4-9, 32-53, 66-72, 74-90, 97-104, 110-130, 133-139, 144-152, 166-177, 203-213, 215-241, 256-275, 291-304, 307-316, 321-326, 334-345, 352-367 | 2 | G | 201-255 | 35, 222 |
| KPORF-20 | Hypothetical protein, no homology | 13-19, 26-43, 66-72, 80-85, 95-101, 109-125, 131-137 | 7 | C | 25-107 | 36, 223 |
| KPORF-21 | Regulator, OraA protein | 13-24, 35-43, 50-56, 58-68, 77-83, 104-110, 117-125, 132-138, 140-153 | 4 | D | 19-66 | 37, 224 |
| KPORF-22 | DNA mismatch repair protein mutS | 15-31, 37-42, 47-54, 68-87, 89-96, 107-117, 121-127, 131-137, 145-151, 176-182, 220-226, 232-246, 250-257, 291-300, 317-325, 328-333, 337-359, 368-393, 403-428, 460-478, 480-493, 500-506, 511-516, 519-526, 528-559, 565-572, 584-595, 597-605, 608-613, 626-648, 679-684, 687-693, 703-714, 718-735, 742-750, 757-765, 768-788, 793-799, 813-819, 823-829, 839-850 | 2 | G | 576-623 | 38, 225 |
| KPORF-23 | Hydrogenase isoenzyme HypD | 10-35, 37-60, 63-76, 79-86, 88-97, 108-113, 118-126, 128-134, 138-145, 153-159, 168-188, 194-208, 211-243, 255-260, 270-276, 285-301, 307-346, 348-367 | 2 | C | 275-339 | 39, 226 |
| KPORF-24 | Selenocysteine lyase | 4-17, 21-33, 35-42, 47-64, 72-80, 85-92, 98-103, 125-147, 151-161, 165-177, 183-230, 232-246, 256-262, 284-306, 310-328, 331-367, 369-383, 392-399 | 2 | H | 32-85 | 40, 227 |
| KPORF-25 | Ribose-phosphate pyrophosphokinase | 5-11, 18-27, 42-52, 60-65, 75-84, 90-102, 107-116, 125-178, | 2 | H | 267-313 | 41, 228 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 184-206, 221-233, 235-242, 249-257, 264-277, 288-317 | | | | |
| KPORF-26 | TonB | 5-11, 14-42, 50-75, 79-86, 89-98, 120-125, 152-160, 166-181, 185-193, 200-207 | 8 | F | 85-114 | 42, 229 |
| KPORF-27 | Putative phosphatase | 4-30, 36-43, 46-55, 63-111, 144-152, 159-168, 179-189, 191-200, 205-213 | 2 | D | 37-109 | 43, 230 |
| KPORF-28 | Similarity to flavoprotein | 20-45, 57-77, 80-100, 119-126, 131-137, 143-169, 179-185, 195-203, 207-231, 235-264, 282-302, 320-329, 341-347, 353-359, 361-373 | 7 | A | 266-296 | 44, 231 |
| KPORF-29 | Outer membrane channel protein | 5-22, 24-37, 41-55, 57-65, 72-78, 90-103, 105-116, 119-130, 164-170, 190-202, 209-231, 244-254, 260-276, 300-339, 344-350, 355-376, 389-397, 399-406, 408-421, 429-437 | 2 | H | 103-152 | 45, 232 |
| KPORF-30 | Membrane-bound ATP synthase, F1 sector, alpha-subunit | 8-16, 18-25, 31-47, 71-82, 87-102, 104-114, 126-156, 176-183, 190-200, 205-212, 218-228, 231-243, 256-279, 287-301, 303-312, 324-332, 335-348, 351-357, 365-380, 395-412, 422-451, 456-464, 467-483, 501-507 | 3 | H | 405-468 | 46, 233 |
| KPORF-31 | Hypothetical protein | 4-18, 21-39, 46-56, 63-69, 72-86, 116-130, 132-160, 162-190, 196-201, 209-231, 233-241, 251-265, 269-282, 292-298, 309-324, 333-369, 391-415, 417-427, 436-454, 471-480, 482-499, 510-518, 521-533, 537-543, 545-561, 571-581, 585-597, 599-607, 609-635, 638-643, 650-665, 671-685, 687-695, 701-707, 710-720, 724-736, 747-757, 764-769, 772-784, 791-796, 808-820 | 2 | C | 317-401 | 47, 234 |
| KPORF-32 | Putative periplasmic protein | 4-12, 15-33, 58-77, 82-89, 98-106, 108-118, 120-135, 141-147, 152-160, 168-215, 225-233, 235-247, 250-264, 284-312, 314-321, 336-343, 359-374, 386-394 | 2 | D | 159-218 | 48, 235 |
| KPORF-33 | D-ribulose-5-phosphate 3-epimerase | 4-16, 24-36, 40-47, 49-56, 61-81, 84-143, 148-156, 158-164, 170-175, 194-206, 208-214 | 5 | H | 126-203 | 49, 236 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPORF-34 | Hypothetical protein | 28-45, 50-61, 94-111, 113-124, 137-142, 147-173, 180-188, 190-196, 202-223, 229-235, 239-249, 262-270, 280-288, 290-321, 325-332, 347-355, 359-368, 389-407, 415-427, 429-453, 458-465, 477-485, 499-505, 516-527, 531-549, 569-592, 594-602, 605-615, 628-635, 647-659, 662-683, 727-735, 760-765, 771-780, 788-809, 811-818 | 2 | D | 549-630 | 50, 237 |
| KPORF-35 | Hypothetical protein | 21-28, 33-40, 48-100, 104-111, 113-134 | 2 | H | 1-46 | 51, 238 |
| KPORF-36 | 30S ribosomal subunit protein S5 | 12-24, 31-41, 53-61, 73-87, 112-128, 133-140, 151-156 | 2 | H | 26-98 | 52, 239 |
| KPORF-37 | Nitrite reductase large subunit | 4-9, 19-26, 32-56, 58-67, 71-81, 90-95, 97-105, 112-118, 124-132, 138-144, 147-167, 169-177, 199-207, 212-217, 231-241, 250-260, 266-272, 274-282, 289-296, 299-310, 316-331, 344-350, 352-363, 368-377, 381-394, 399-406, 412-450, 459-473, 486-503, 508-514, 518-548, 564-570, 579-587, 602-608, 616-623, 628-635, 638-654, 678-688, 691-696, 703-709, 716-723, 761-772, 784-793, 819-826, 835-844 | 2 | D | 790-834 | 53, 240 |
| KPORF-38 | Putative inner membrane lipoprotein | 4-10, 18-36, 43-50, 63-71, 75-105, 109-117, 134-140, 145-157, 176-182, 184-201, 203-211, 215-225, 240-250, 262-284, 294-309, 313-319, 327-337, 350-356, 361-367, 372-393, 411-421, 428-451, 453-466, 487-492, 501-528, 535-553, 564-574, 592-605, 612-629, 631-640, 646-653, 658-666, 673-681, 713-718, 720-730, 739-749, 784-792, 821-826, 833-844, 853-863, 871-876, 885-894, 900-918, 937-950, 952-957, 972-990, 995-1001, 1024-1036, 1039-1044, 1049-1055, 1062-1089, 1091-1103, 1110-1121, 1123-1129, 1131-1151, | 2 | A | 761-781 | 54, 241 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 1157-1179, 1181-1201, 1204-1223, 1233-1244, 1269-1276, 1279-1286, 1294-1301, 1303-1309, 1315-1338, 1350-1362, 1373-1381, 1398-1406, 1412-1423, 1440-1446, 1458-1466, 1481-1487, 1492-1508, 1511-1518, 1528-1534, 1536-1547, 1553-1565, 1606-1617, 1619-1644 | | | | |
| KPORF-39 | Recombinational DNA repair protein | 6-13, 31-38, 47-60, 71-102, 107-123, 128-155, 173-179, 185-194, 210-220 | 2 | H | 161-232 | 55, 242 |
| KPORF-40 | Putative regulatory protein | 11-34, 36-43, 49-67, 74-79, 84-92, 94-100, 103-112, 120-129, 134-155, 162-173, 177-185, 189-202, 206-211 | 2 | G | 130-185 | 56, 243 |
| KPORF-41 | S-adenosylmethionine synthetase | 4-10, 20-35, 37-46, 48-55, 60-66, 75-82, 87-98, 133-150, 166-172, 178-189, 208-214, 230-235, 245-251, 271-308, 319-333, 335-355, 373-380 | 4 | H | 117-201 | 57, 244 |
| KPORF-42 | A/G-specific DNA glycosylase | 4-30, 54-65, 91-105, 107-131, 135-154, 163-192, 199-208, 210-224, 229-239, 248-257, 263-279, 281-294, 328-354, 373-379, 382-405, 426-453, 462-487 | 1 | G | 249-323 | 58, 245 |
| KPORF-43 | Hypothetical protein | 4-10, 12-24, 45-55, 75-88 | 6 | E | 24-40 | 59, 246 |
| KPORF-44 | Transketolase | 4-14, 20-37, 47-53, 55-61, 75-81, 97-103, 107-124, 129-135, 139-147, 160-166, 169-175, 181-190, 202-221, 247-255, 272-285, 300-310, 318-332, 351-361, 384-397, 406-427, 442-449, 458-482, 494-503, 512-524, 531-539, 552-562, 577-588, 590-596, 600-608, 613-624, 637-668, 692-700 | 2 | D | 232-278 | 60, 247 |
| KPORF-45 | Putative S-adenosylmethionine-dependent methyltransferase | 33-39, 49-55, 68-84, 90-96, 104-120, 126-143, 150-159, 168-191, 197-208, 219-225, 227-233, 241-247 | 4 | G, H | 63-115, 200-250 | 61, 248 |
| KPORF-46 | Nucleoside-diphosphate-sugar epimerase | 4-22, 24-34, 36-55, 57-76, 83-97, 99-117, 135-143, 145-157, 163-174, 178-198, 200-207, 209-270, 276-290, 321-335, 338-347, 367-374, 393-402, 404-411, | 5 | G, H | 117-183 | 62, 249 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 416-422, 443-460, 467-473 | | | | |
| KPORF-47 | Coenzyme F420-dependent N5,N10-methylene tetrahydromethanopterin reductase and related flavin-dependent oxidoreductases | 26-37, 44-52, 57-96, 104-111, 118-124, 155-177, 179-197, 201-214, 223-233, 243-250, 257-262, 291-297, 303-314, 319-363 | 6 | G | 47-105 | 63, 250 |
| KPORF-48 | ATP/GTP-binding protein | 36-43, 45-60, 76-97, 107-125, 131-156, 158-164 | 2 | G | 118-163 | 64, 251 |
| KPORF-49 | ABC transporter, substrate binding protein | 5-32, 40-50, 52-60, 70-88, 92-101, 106-126, 138-150, 152-161, 175-193, 201-234, 237-248, 270-285, 297-303, 312-318 | 3 | D | 209-255 | 65, 252 |
| KPORF-50 | Putative PTS system IIA component | 4-12, 23-34, 49-55, 59-65, 70-81, 83-130 | 2 | D | 62-113 | 66, 253 |
| KPORF-51 | Putative phosphatase | 4-26, 38-49, 69-76, 82-96, 103-119, 126-140, 143-190, 194-209, 212-218 | 3 | D | 100-167 | 67, 254 |
| KPORF-52 | Putative lipoprotein | 7-29, 35-47, 56-66, 80-94, 97-123, 125-148, 150-160, 166-173, 175-191, 193-200, 207-225 | 18 | C | 75-176 | 68, 255 |
| KPORF-53 | Conserved hypothetical protein | 14-36, 39-45, 51-59, 66-71, 76-88, 106-117, 121-126, 140-157, 164-187, 198-206, 210-252 | 9 | G | 202-256 | 69, 256 |
| KPORF-54 | Membrane-bound lytic murein transglycosylase d precursor | 4-19, 27-35, 90-107, 120-134, 144-150, 166-175, 192-198, 221-243, 249-255, 263-278, 283-288, 305-321, 324-334, 342-349, 355-366, 377-390, 413-425, 442-448 | 2 | D | 130-178 | 70, 257 |
| KPORF-55 | Similar to rRNA methylases | 17-26, 41-51, 54-61, 64-72, 78-105, 117-125, 127-137, 147-155, 175-213, 230-236, 238-261, 271-277, 282-297, 309-318, 329-347, 355-372, 377-390 | 4 | D | 69-126 | 71, 258 |
| KPORF-56 | Apolipoprotein N-acyltransferase | 4-48, 54-60, 62-69, 73-81, 88-115, 124-137, 139-154, 156-169, 171-190, 194-231, 240-273, 288-303, 336-363, 367-395, 405-411, 434-442, 449-454, 466-483, 491-507 | 2 | G | 226-282 | 72, 259 |
| KPORF-57 | Putative carboxylase | 26-34, 39-47, 50-80, 82-88, 97-105, 108-127, 131-137, 162-180, 185-191, 198-203, 209-214, 226-247, 256-288, 296-305 | 2 | D | 149-239 | 73, 260 |
| KPORF-58 | Putative transport protein | 5-28, 30-54, 73-84, 89-98, 109-116, 122-128, 137-142, 163-189, 207-236, 245-280, 288-390, | 2 | D | 6-62 | 74, 261 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 404-423, 426-433, 450-474, 487-504, 506-513, 524-530, 532-595, 605-614, 620-626, 631-638, 644-657, 667-683, 686-693, 695-702, 707-733, 739-747 | | | | |
| KPORF-59 | Similarity Anaerobic dehydrogenases | 23-31, 39-50, 55-67, 76-100, 117-130, 149-171, 173-185, 218-238, 242-288, 291-298, 334-346, 355-369, 382-399, 413-420, 431-438, 442-449, 455-466, 486-493, 498-508, 524-531, 540-546, 551-558, 562-570, 575-582, 585-596, 598-604, 621-630, 632-650, 670-677, 682-701, 736-749, 755-761 | 4 | A | 612-626 | 75, 262 |
| KPORF-60 | Similarity glutamine-binding periplasmic protein precursor | 4-21, 24-39, 44-68, 74-81, 85-91, 109-116, 129-138, 142-148, 173-188, 195-201, 207-212, 223-228 | 2 | A | 126-148 | 76, 263 |
| KPORF-61 | Putative cytoplasmic protein | 4-17, 24-42, 61-67, 84-93, 96-102, 116-121, 135-143, 155-165, 177-186, 210-224, 253-259, 272-297, 299-331, 337-351, 359-367, 369-385 | 7 | G, H | 1-49 | 77, 264 |
| KPORF-62 | Probable transcriptional regulator | 4-25, 28-54, 67-81, 85-136, 138-143, 157-170, 180-190, 197-203, 205-214, 219-243, 246-270, 277-283, 290-299, 305-311 | 4 | G | 127-182 | 78, 265 |
| KPORF-63 | Hypothetical protein | 11-20, 25-33, 75-80, 85-91, 113-124, 143-155, 161-170, 172-184 | 2 | D | 128-176 | 79, 266 |
| KPORF-64 | Extracellular solute-binding protein, family 3 | 4-9, 16-26, 28-34, 55-80, 120-143, 150-156, 158-164, 167-178, 185-190, 192-213, 221-237, 242-255, 257-272, 281-290, 325-332 | 26 | G | 48-106 | 80, 267 |
| KPORF-65 | Penicillin-binding protein | 13-48, 59-70, 78-88, 95-112, 129-151, 153-161, 163-182, 214-221, 235-245, 248-277, 281-291, 293-301, 303-311, 315-320, 323-346, 377-383, 390-398, 447-454, 474-487, 491-512, 531-544, 547-553, 582-590, 597-603, 605-611, 623-629 | 4 | C | 410-466 | 81, 268 |
| KPORF-66 | Outer membrane porin, receptor for ferric enterobactin (enterochelin) and colicins B and D | 6-26, 39-46, 48-58, 69-75, 109-121, 139-144, 148-155, 166-172, 215-221, 261-267, 313-319, 363-386, 423-433, | 2 | D | 152-206 | 82, 269 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| | | 447-458, 465-471, 483-494, 497-517, 558-565, 578-586, 589-597, 619-626, 636-645, 659-665, 671-680, 682-693, 733-739 | | | | |
| KPORF-67 | Hypothetical protein | 4-19, 23-35, 40-50, 52-58, 65-73, 78-103, 112-125, 146-160, 163-192, 194-200 | 2 | H | 29-90 | 83, 270 |
| KPORF-68 | Hypothetical protein | 4-13, 17-32, 40-50, 57-67, 76-81, 88-95, 107-119, 131-142, 144-157, 171-178, 185-193, 197-207, 212-227, 231-238, 248-253, 263-310 | 2 | D | 90-170 | 84, 271 |
| KPORF-69 | 3-phytase precursor | 9-28, 57-82, 84-93, 126-135, 143-166, 173-194, 196-201, 212-220, 228-254, 269-277, 289-298, 305-316, 320-327, 330-337, 350-359, 373-378, 386-392, 403-411, 421-428, 435-441, 443-458, 465-470 | 2 | D | 80-141 | 85, 272 |
| KPORF-70 | Cation/multidrug efflux pump | 11-48, 54-67, 69-75, 89-95, 101-122, 124-131, 134-157, 159-175, 202-208, 214-228, 258-270, 272-280, 287-295, 298-310, 331-338, 340-417, 427-500, 502-509, 534-552, 556-561, 564-577, 585-592, 594-608, 621-627, 632-641, 643-652, 671-681, 683-709, 712-743, 758-764, 776-783, 789-820, 835-851, 864-883, 885-910, 913-940, 948-953, 967-976, 994-1020 | 1 | H | 775-825 | 86, 273 |
| KPORF-71 | ferric enterobactin transport ATP-binding protein | 14-24, 32-54, 58-63, 70-80, 93-100, 108-125, 127-135, 142-153, 155-160, 180-191, 201-208, 210-216, 222-235, 242-264, 267-273, 276-282, 284-308 | 5 | H | 10-59 | 87, 274 |
| KPORF-72 | ATP-dependent protease La | 16-28, 44-68, 70-77, 83-90, 99-129, 131-137, 145-154, 161-175, 183-190, 196-203, 205-220, 238-245, 321-328, 330-338, 366-379, 383-397, 399-405, 412-418, 442-458, 471-483, 486-505, 536-544, 562-568, 583-602, 610-618, 629-635, 641-655, 672-682, 697-705, 714-729, 744-751, 755-762, 766-771, 783-807 | 2 | D | 555-621 | 88, 275 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPORF-73 | Predicted Fe—S oxidoreductase | 4-9, 20-34, 45-54, 60-77, 79-89, 91-100, 102-149, 162-170, 177-189, 193-208, 210-222, 238-244, 252-264, 267-276, 302-307 | 2 | D | 100-140 | 89, 276 |
| KPORF-74 | Probable transcriptional regulator, LysR family | 11-27, 30-49, 56-62, 69-74, 76-85, 94-108, 116-125, 129-147, 153-161, 165-171, 177-208, 217-223, 225-231, 237-255, 260-284, 293-300 | 10 | G, H | 73-137 | 90, 277 |
| KPORF-75 | Hypothetical protein | 4-38, 40-51, 84-97, 99-106, 109-115, 119-129, 131-145, 148-160, 180-186, 188-202, 230-243, 246-267, 274-288, 290-299, 302-312, 317-327, 332-344, 353-377, 381-388, 407-419, 423-437, 447-470, 474-482, 486-494, 501-523, 531-546, 551-556 | 2 | E | 727-740 | 91, 278 |
| KPORF-76 | Hypothetical protein | 23-52, 62-76, 87-104, 109-115, 117-123, 129-139, 143-149, 152-170, 172-191, 199-205, 212-218, 220-240, 249-256, 263-275, 297-303, 308-342, 349-380, 382-394, 414-420, 430-441, 446-452, 460-475, 488-505, 514-531, 533-539, 546-568, 570-577, 579-588, 613-625, 632-670, 672-716, 718-745, 759-769, 785-798, 801-807 | 3 | C | 272-324 | 92, 279 |
| KPORF-77 | Hypothetical protein, (located as CRF in ABC transporter substrate-binding protein) | 4-34, 36-43, 56-73, 80-87, 101-134, 148-159, 161-170, 178-185, 195-206, 211-221, 223-248, 259-271, 276-295, 297-308 | 2 | C | 241-296 | 93, 280 |
| KPORF-78 | Maltoporin | 5-31, 44-50, 64-74, 86-94, 132-147, 154-167, 196-203, 209-219, 253-260, 284-289, 300-312, 319-327, 335-340, 358-364, 376-383 | 4 | E | 166-202 | 94, 281 |
| KPORF-79 | Hypothetical protein | 4-9, 12-27, 29-71, 77-84, 90-108, 114-142, 147-164, 180-213, 217-227, 229-282, 291-309, 322-329, 336-353, 365-370 | 3 | G | 317-364 | 95, 282 |
| KPORF-80 | Methyl-accepting chemotaxis protein | 36-41, 52-66, 71-83, 89-95, 116-127, 154-174, 176-184, 200-206, 230-237, 248-259, 269-284, 307-316, 376-383, 399-418, 424-442, 445-451, 454-462 | 2 | H | 1-50 | 96, 283 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPORF-81 | Type I restriction-modification system DNA methylase | 9-14, 33-49, 64-72, 87-92, 103-109, 123-128, 130-141, 143-154, 160-166, 182-214, 237-247, 251-260, 292-300, 327-332, 337-350, 357-365, 388-398, 405-411, 422-428, 451-459, 478-488, 520-531, 534-540, 558-564, 580-586, 591-600, 605-615, 629-635, 641-653, 658-672 | 4 | C | 212-244, 533-611 | 97, 284 |
| KPORF-82 | Pyruvate dehydrogenase E2 component | 4-10, 17-27, 30-37, 44-62, 80-85, 94-114, 118-131, 134-141, 148-161, 171-212, 218-241, 248-261, 274-313, 325-336, 342-348, 359-373, 391-397, 424-431, 454-474, 489-495, 497-503, 505-515, 548-553, 560-580, 591-610 | 2 | C | 277-324 | 98, 285 |
| KPORF-83 | Sulfite reductase [NADPH] flavoprotein alpha-component | 7-16, 18-24, 30-47, 49-70, 83-99, 103-117, 126-141, 146-153, 159-165, 177-194, 198-221, 236-246, 255-262, 273-279, 283-296, 301-332, 338-411, 422-428, 434-440, 452-458, 463-469, 494-509, 511-517, 524-531, 548-554, 564-572 | 23 | H | 335-389 | 99, 286 |
| KPARF-01 | Hypothetical protein | 9-15, 33-54, 56-80, 102-108 | 10 | G | 1-42 | 100, 287 |
| KPARF-02 | Hypothetical protein | 15-36, 42-55, 58-68 | 83 | E, F | 54-77 | 101, 288 |
| KPARF-03 | Hypothetical protein | 55-75, 89-96, 98-110 | 51 | E, F | 14-36 | 102, 289 |
| KPARF-04 | Hypothetical protein | 8-14, 29-51, 73-101, 110-117 | 31 | E, H | 70-114 | 103, 290 |
| KPARF-05 | Hypothetical protein | 20-25, 29-34, 41-52, 60-67, 69-85, 90-100, 114-122, 136-142, 160-170, 174-181 | 5 | H | 21-58 | 104, 291 |
| KPARF-06 | Hypothetical protein | 14-22 | 33 | E, F | 4-13 | 105, 292 |
| KPARF-07 | Hypothetical protein | 22-40, 54-66, 88-105, 109-118 | 4 | G | 31-74 | 106, 293 |
| KPARF-08 | Hypothetical protein | 5-11, 18-32, 47-60, 66-73, 83-92, 113-120, 126-141, 151-164, 167-174, 201-211 | 14 | F | 118-129 | 107, 294 |
| KPARF-09 | Hypothetical protein | 5-11, 18-24, 32-40, 47-53 | 38 | E | 25-54 | 108, 295 |
| KPARF-10 | Hypothetical protein | 18-24, 31-48 | 22 | H | 5-55 | 109, 296 |
| KPARF-11 | Hypothetical protein | 10-16, 26-32, 47-56, 85-95 | 9 | G | 10-62 | 110, 297 |
| KPARF-12 | Hypothetical protein | 4-12, 16-26 | 9 | F | 25-34 | 111, 298 |
| KPARF-13 | Hypothetical protein | 19-29, 45-51, 63-68, 76-92, 103-110, 114-120, 123-133, 135-141 | 3 | H | 14-78 | 112, 299 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPARF-14 | Hypothetical protein | 4-18, 47-61 | 3 | E | 57-93 | 113, 300 |
| KPARF-15 | Hypothetical protein | 17-29, 44-50 | 5 | F | 26-38 | 114, 301 |
| KPARF-16 | Hypothetical protein | 5-19, 55-64, 78-85, 95-101, 104-112 | 2 | A | 24-33 | 115, 302 |
| KPARF-17 | Hypothetical protein | 4-10 | 3 | A | 12-31 | 116, 303 |
| KPARF-18 | Hypothetical protein | 4-12, 27-41, 43-58, 60-67, 76-86 | 3 | G | 13-65 | 117, 304 |
| KPARF-19 | Hypothetical protein | 30-38, 57-67 | 2 | F | 5-32 | 118, 305 |
| KPARF-20 | Hypothetical protein | 30-43 | 4 | A | 2-21 | 119, 306 |
| KPARF-21 | Hypothetical protein | 14-20, 23-36, 41-48 | 3 | C | 1-52 | 120, 307 |
| KPARF-22 | Hypothetical protein | 18-33, 51-58, 76-82 | 3 | B | 32-46 | 121, 308 |
| KPARF-23 | Hypothetical protein | 25-31 | 2 | E | 2-16 | 122, 309 |
| KPARF-24 | Hypothetical protein | 14-23, 50-58 | 3 | G | 9-49 | 123, 310 |
| KPARF-25 | Hypothetical protein | 4-10, 22-31, 35-45, 48-68, 71-80 | 2 | G | 17-66 | 124, 311 |
| KPARF-26 | Hypothetical protein | 4-24, 28-42, 46-56, 63-69, 87-94, 112-131 | 3 | H | 2-46 | 125, 312 |
| KPARF-27 | Hypothetical protein | 4-15, 19-28, 34-41, 52-62, 78-86 | 3 | E | 2-20 | 126, 313 |
| KPARF-28 | Hypothetical protein | 4-11, 16-30, 32-42 | 5 | H | 7-38 | 127, 314 |
| KPARF-29 | Hypothetical protein | 4-20, 22-31 | 7 | A | 22-38 | 128, 315 |
| KPARF-30 | Hypothetical protein | 4-19 | 3 | F | 17-32 | 129, 316 |
| KPARF-31 | Hypothetical protein | 7-13, 17-22, 27-33, 80-100 | 2 | F | 26-40 | 130, 317 |
| KPARF-32 | Hypothetical protein | 10-18, 22-48 | 2 | E | 32-44 | 131, 318 |
| KPARF-33 | Hypothetical protein | 15-24, 43-49, 73-83 | 2 | G | 45-93 | 132, 319 |
| KPARF-34 | Hypothetical protein | 22-29, 46-55, 57-63 | 3 | A | 5-17 | 133, 320 |
| KPARF-35 | Hypothetical protein | 10-33 | 2 | F | 21-35 | 134, 321 |
| KPARF-36 | Hypothetical protein | 16-24 | 2 | A | 22-49 | 135, 322 |
| KPARF-37 | Hypothetical protein | 4-16, 37-73, 76-110, 117-125, 127-132 | 2 | A | 2-30 | 136, 323 |
| KPARF-38 | Hypothetical protein | 4-12, 23-35, 44-56, 59-88 | 2 | H | 22-76 | 137, 324 |
| KPARF-39 | Hypothetical protein | 15-26 | 2 | F | 23-35 | 138, 325 |
| KPARF-40 | Hypothetical protein | 12-22, 31-40 | 2 | F | 17-44 | 139, 326 |
| KPARF-41 | Hypothetical protein | 4-9, 13-18, 29-35 | 2 | B | 57-64 | 140, 327 |
| KPARF-42 | Hypothetical protein | 31-55, 67-81 | 2 | H | 25-70 | 141, 328 |
| KPARF-43 | Hypothetical protein | 13-24, 51-58 | 2 | E | 13-26 | 142, 329 |
| KPARF-44 | Hypothetical protein | 6-20, 29-40, 57-79 | 3 | H | 46-88 | 143, 330 |
| KPARF-45 | Hypothetical protein | 8-14, 41-54, 68-76, 83-93, 106-126, 130-139 | 3 | G | 12-72 | 144, 331 |
| KPARF-46 | Hypothetical protein | 5-13, 17-24, 41-55, 64-69, 80-85, 94-107, 109-115 | 5 | G | 53-88 | 145, 332 |
| KPARF-47 | Hypothetical protein | 5-12, 32-54, 57-64 | 2 | A | 20-33 | 146, 333 |
| KPCRF-01 | Hypothetical protein | 4-16, 40-48, 50-58, 62-68, 75-85, 92-104, 108-116, 124-134 | 5 | C | 68-128 | 147, 334 |

TABLE 1-continued

Immunogenic proteins identified from *K. pneumoniae* by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPCRF-02 | Hypothetical protein | 7-13, 19-29, 34-40, 54-71, 76-81, 91-144, 147-155, 157-188 | 19 | D, F | 11-83 | 148, 335 |
| KPCRF-03 | Hypothetical protein | 17-24, 32-41 | 79 | A, E, F | 6-43 | 149, 336 |
| KPCRF-04 | Hypothetical protein | 14-31, 38-59, 69-87, 95-102, 126-146, 157-162, 177-193, 201-227, 238-251 | 11 | E | 63-78 | 150, 337 |
| KPCRF-05 | Hypothetical protein | 10-16, 18-25, 27-41, 43-52, 59-86, 94-101, 134-140 | 5 | H | 38-100 | 151, 338 |
| KPCRF-06 | Hypothetical protein | 4-19, 23-35, 43-72, 78-92 | 3 | H | 37-93 | 152, 339 |
| KPCRF-07 | Hypothetical protein | 15-20, 27-32, 41-65, 69-82, 93-105, 107-115, 120-147, 170-178, 184-201, 214-257, 272-281, 293-314, 332-339, 358-364, 374-381, 390-397, 399-414, 428-460 | 2 | C | 317-375 | 153, 340 |
| KPCRF-08 | Hypothetical protein | 11-28, 47-55, 59-68, 76-105, 108-116, 120-144, 146-160, 167-175, 180-187, 209-233 | 2 | A | 144-158 | 154, 341 |
| KPCRF-09 | Hypothetical protein | 4-13, 58-78 | 31 | H | 14-77 | 155, 342 |
| KPCRF-10 | Hypothetical protein | 26-31, 44-49, 57-64, 67-74, 107-112, 116-152, 154-181, 202-212, 241-255 | 30 | A, E, F, G | 57-101 | 156, 343 |
| KPCRF-11 | Hypothetical protein | 10-41, 53-70, 81-93, 100-111, 137-147, 164-169, 183-190, 199-210, 216-221, 226-240 | 21 | E, F | 84-95 | 157, 344 |
| KPCRF-12 | Hypothetical protein | 12-45, 48-56, 73-79, 91-103, 106-112, 117-125, 132-143, 154-160, 178-201, 208-214, 216-225, 260-266, 276-283 | 3 | F | 98-115 | 158, 345 |
| KPCRF-13 | Hypothetical protein | 4-15, 30-42 | 2 | B | 29-39 | 159, 346 |
| KPCRF-14 | Hypothetical protein | 22-53, 55-73, 80-88 | 3 | A | 33-66 | 160, 347 |
| KPCRF-15 | Hypothetical protein | 6-23, 44-54 | 7 | F | 56-67 | 161, 348 |
| KPCRF-16 | Hypothetical protein | 8-21, 35-44, 66-75, 82-87, 94-101 | 3 | C | 32-94 | 162, 349 |
| KPCRF-17 | Hypothetical protein | 8-20, 23-32, 36-50, 53-69 | 4 | H | 15-69 | 163, 350 |
| KPCRF-18 | Hypothetical protein | | 5 | F | 8-22 | 164, 351 |
| KPCRF-19 | Hypothetical protein | 31-37 | 5 | A | 2-31 | 165, 352 |
| KPCRF-20 | Hypothetical protein | 4-20, 23-39, 58-63, 71-78, 97-102 | 2 | D | 22-82 | 166, 353 |
| KPCRF-21 | Hypothetical protein | 23-44, 135-152, 168-184 | 2 | C | 57-116 | 167, 354 |
| KPCRF-22 | Hypothetical protein | 24-31, 42-50, 52-62, 93-117 | 2 | D | 43-94 | 168, 355 |
| KPCRF-23 | Hypothetical protein | 20-29 | 10 | E | 24-43 | 169, 356 |
| KPCRF-24 | Hypothetical protein | 12-57, 59-74 | 2 | A | 22-40 | 170, 357 |
| KPCRF-25 | Hypothetical protein | 7-16, 18-26, 39-45, 68-78, 86-92 | 2 | A | 65-82 | 171, 358 |

TABLE 1-continued

Immunogenic proteins identified from K. pneumoniae by bacterial surface display.

| ORF | Putative function (by homology) | Predicted immunogenic aa* | No. of selected clones | Identified in Screen | Location of identified immunogenic region (aa) | SeqID (DNA, Prot.) |
|---|---|---|---|---|---|---|
| KPCRF-26 | Hypothetical protein | 5-17, 19-34, 42-48, 56-71, 102-113, 118-129 | 6 | H | 67-111 | 172, 359 |
| KPCRF-27 | Hypothetical protein | 4-33, 50-71 | 3 | D | 13-55 | 173, 360 |
| KPCRF-28 | Hypothetical protein | 9-17, 23-30, 37-54, 69-88, 96-102, 114-123, 130-140, 143-163 | 2 | D | 5-70 | 174, 361 |
| KPCRF-29 | Hypothetical protein | 4-23, 27-52, 71-80 | 11 | C, H | 9-94 | 175, 362 |
| KPCRF-30 | Hypothetical protein | 13-19 | 5 | A | 2-21 | 176, 363 |
| KPCRF-31 | Hypothetical protein | 18-26, 28-52, 63-74, 94-107, 123-134 | 2 | D | 18-84 | 177, 364 |
| KPCRF-32 | Hypothetical protein | 19-33, 57-68 | 3 | A | 26-48 | 178, 365 |
| KPCRF-33 | Hypothetical protein | 4-26, 31-37, 42-59 | 7 | H | 12-65 | 179, 366 |
| KPCRF-34 | Hypothetical protein | 4-25 | 1 | A | 20-39 | 180, 367 |
| KPCRF-35 | Hypothetical protein | 40-51, 54-62, 67-75, 83-89, 126-146, 148-156 | 3 | A | 31-42 | 181, 368 |
| KPCRF-36 | Hypothetical protein | 4-15, 23-33, 38-49, 82-98 | 2 | H | 7-91 | 182, 369 |
| KPCRF-37 | Hypothetical protein | 6-26, 36-57 | 2 | F | 40-64 | 183, 370 |
| KPCRF-38 | Hypothetical protein | 6-15, 21-28, 32-38, 57-65, 78-103, 114-134, 138-144, 154-163 | 13 | H | 41-95 | 184, 371 |
| KPCRF-39 | Hypothetical protein | 13-30, 47-57, 71-76 | 2 | C | 25-71 | 185, 372 |
| KPCRF-40 | Hypothetical protein | 4-31, 43-51, 55-63, 67-72, 76-83, 88-95, 99-118, 125-132, 134-159 | 2 | F | 82-118 | 186, 373 |
| KPCRF-41 | Hypothetical protein | 4-17, 26-32, 34-40, 45-61, 67-92 | 2 | H | 41-97 | 187, 374 |

A, 50 bp library of K. pneumoniae in lamB with the ICKp18-IgG pool containing the IC38, IC40, IC76 and IC86 (562 trimmed clones),
B, 50 bp library of K. pneumoniae in lamB with the ICKp19-IgG pool containing the IC88, IC89, IC92 and IC93 sera (444 trimmed clones),
C, 300 bp library of K. pneumoniae in fhuA with the ICKp18-IgG pool containing the IC38, IC40, IC76 and IC86 sera (455 trimmed clones),
D, 300 bp library of K. pneumoniae in fhuA with the ICKp19-IgG pool containing the IC88, IC89, IC92, and IC93 sera (591 trimmed clones),
E, 50 bp library of K. pneumoniae in lamB with the PKp34 pool (P3536.2, P3548, P3560, P3582 and P3583 sera) (618 trimmed clones),
F, 50 bp library of K. pneumoniae in lamB with the PKp35 pool (P3495.2, P3533.2, P3567 and P3576 sera) (562 trimmed clones),
G, 300 bp library of K. pneumoniae in fhuA with the PKp34 pool (P3536.2, P3548, P3560, P3582 and P3583 sera) (562 trimmed clones),
H, 300 bp library of K. pneumoniae in fhuA with the PKp35 pool (P3495.2, P3533.2, P3567 and P3576 sera) (593 trimmed clones); P3536.2, P3495.2 and P3533.2 were convalescent sera obtained from patients after recovering from sickness,
*prediction of antigenic sequences longer than 5 amino acids was performed with the program ANTIGENIC (Kolaskar, A. et al., 1990).
Listed are the genes from K. pneumoniae as identified by BLAST of the determined epitope sequence against the genomic sequence of K. pneumoniae MGH78578 (NCBI, Bethesda, Md or the German Research Center for Environmental Health).
The numbering of the ORFs is arbitrary.
The annotation/putative function was mainly obtained by homology to open reading frames from other bacterial species, preferentially Gram negative bacteria.

TABLE 2

List of strains used for gene distribution analysis.

| No | Strain ID | Species | K-type | O-type |
|---|---|---|---|---|
| 1 | A 5054 | K. pneumoniae | 1 | 1 |
| 2 | i252/94 | K. pneumoniae | 1 | 3 |
| 3 | B 5055 | K. pneumoniae | 2 | 1 |
| 4 | i225/94 | K. pneumoniae | 3 | 1 |
| 5 | C 5046 | K. pneumoniae | 3 | 2 |
| 6 | D 5050 | K. ozaenae | 4 | 2ac |
| 7 | E 5051 | K. ozaenae | 5 | 2ac |
| 8 | Aerogenes 4140 | K. pneumoniae | 7 | 1 |
| 9 | 1015 | K. planticola | 8 | 1 |
| 10 | i272/94 | K. pneumoniae | 8 | 3 |
| 11 | 919 | K. pneumoniae | 10 | 1 |
| 12 | 313 | K. pneumoniae | 12 | 1 |
| 13 | 1470 | K. pneumoniae | 13 | O- |
| 14 | 1193 | K. planticola | 14 | 5 |
| 15 | Mich61 | K. pneumoniae | 15 | 4 |
| 16 | 2069/49 | K. pneumoniae | 16 | 1 |

TABLE 2-continued

List of strains used for gene distribution analysis.

| No | Strain ID | Species | K-type | O-type |
|---|---|---|---|---|
| 17 | i243/94 | K. pneumoniae | 16 | 3 |
| 18 | 1702/49 | K. pneumoniae | 21 | 1 |
| 19 | i202/94 | K. pneumoniae | 21 | 3 |
| 20 | 1680/49 | K. pneumoniae | 24 | 1 |
| 21 | i257/94 | K. pneumoniae | 24 | 9 |
| 22 | 2002/49 | K. pneumoniae | 25 | 3 |
| 23 | 6613 | K. pneumoniae | 27 | 2 |
| 24 | i192/94 | K. pneumoniae | 27 | 9 |
| 25 | 5758 | K. pneumoniae | 28 | 2 |
| 26 | 5725y | K. oxytoca | 29 | 1 |
| 27 | i219/94 | K. pneumoniae | 29 | 3 |
| 28 | 6258 | K. pneumoniae | 31 | 3 |
| 29 | 6168 | K. pneumoniae | 33 | 3 |
| 30 | i256/94 | K. pneumoniae | 38 | 3 |
| 31 | 8414 | K. pneumoniae | 38 | O− |
| 32 | 7749 | K. planticola | 39 | 1 |
| 33 | 5281 | K. pneumoniae | 46 | 1 |
| 34 | i224/94 | K. pneumoniae | 52 | 3 |
| 35 | 5759/50 | K. pneumoniae | 52 | O− |
| 36 | Stanley | K. planticola | 54 | 3 |
| 37 | i221/94 | K. pneumoniae | 57 | 3 |
| 38 | 4425/51 | K. planticola | 57 | 5 |
| 39 | 264-1 | K. pneumoniae | 67 | 7 |
| 40 | 265-1 | K. pneumoniae | 68 | 2 |
| 41 | i203/94 | K. pneumoniae | 68 | 3 |
| 42 | 889 | K. pneumoniae | 69 | 8 |
| 43 | 708 | K. pneumoniae | 80 | 12 |
| 44 | 370 | K. pneumoniae | 81 | O+ |
| 45 | Friedländer 204 | K. pneumoniae | K− | 1 |
| 46 | 5053 | K. ozaenae | K− | 2a, 2c |
| 47 | MGH78578 | K. pneumoniae | nd | nd |

Table 2 shows different strains of K. pneumoniae isolates analyzed for the gene distribution study. The species and the relevant K- and O-type are given. MGH78578 was used for generating genomic libraries.
nd, not determined.

TABLE 3

Gene distribution analysis for a selected number of antigens in various Klebsiella species and K. pneumoniae strains.

| ORF | SEQ ID NO (DNA) | Gene distribution |
|---|---|---|
| KPORF-01 | 17 | 46/46 |
| KPORF-02 | 18 | 36/46 |
| KPORF-03 | 19 | 12/46 |
| KPORF-04 | 20 | 42/46 |
| KPORF-05 | 21 | 46/46 |
| KPORF-06 | 22 | 17/46 |
| KPORF-07 | 23 | 41/46 |
| KPORF-08 | 24 | 5/46 |
| KPORF-09 | 25 | 41/46 |
| KPORF-10 | 26 | 43/46 |
| KPORF-11 | 27 | 46/46 |
| KPORF-12 | 28 | 22/46 |
| KPORF-13 | 29 | 43/46 |
| KPORF-14 | 30 | 45/46 |
| KPORF-15 | 31 | 40/46 |
| KPORF-16 | 32 | 32/46 |
| KPORF-17 | 33 | 34/46 |
| KPORF-18 | 34 | 39/46 |
| KPORF-19 | 35 | 24/46 |
| KPORF-20 | 36 | 39/46 |
| KPORF-21 | 37 | 43/46 |
| KPORF-22 | 38 | 27/46 |
| KPORF-23 | 39 | 4/46 |
| KPORF-24 | 40 | 28/46 |
| KPORF-25 | 41 | 46/46 |
| KPORF-26 | 42 | 35/46 |
| KPORF-27 | 43 | 43/46 |
| KPORF-28 | 44 | 41/46 |
| KPORF-29 | 45 | 40/46 |
| KPORF-30 | 46 | 46/46 |
| KPORF-31 | 47 | 46/46 |
| KPORF-32 | 48 | 46/46 |
| KPORF-33 | 49 | 46/46 |
| KPORF-34 | 50 | 38/46 |
| KPORF-35 | 51 | 39/46 |
| KPORF-36 | 52 | 46/46 |
| KPORF-37 | 53 | 46/46 |
| KPORF-38 | 54 | 41/46 |
| KPORF-39 | 55 | 39/46 |
| KPORF-40 | 56 | 38/46 |
| KPORF-41 | 57 | 39/46 |
| KPORF-42 | 58 | 46/46 |
| KPORF-43 | 59 | 37/46 |
| KPORF-44 | 60 | 45/46 |
| KPORF-45 | 61 | 46/46 |
| KPORF-46 | 62 | 39/46 |
| KPORF-47 | 63 | 1/46 |
| KPORF-48 | 64 | 39/46 |
| KPORF-49 | 65 | 46/46 |
| KPORF-50 | 66 | 46/46 |
| KPORF-51 | 67 | 7/46 |
| KPORF-52 | 68 | 7/46 |
| KPORF-53 | 69 | 46/46 |
| KPORF-54 | 70 | 46/46 |
| KPORF-55 | 71 | 46/46 |
| KPORF-56 | 72 | 44/46 |
| KPORF-57 | 73 | 40/46 |
| KPORF-58 | 74 | 42/46 |
| KPORF-59 | 75 | 17/46 |
| KPORF-60 | 76 | 46/46 |
| KPORF-61 | 77 | 44/46 |
| KPORF-62 | 78 | 43/46 |
| KPORF-63 | 79 | 35/46 |
| KPORF-64 | 80 | 40/46 |
| KPORF-65 | 81 | 46/46 |
| KPORF-66 | 82 | 42/46 |
| KPORF-67 | 83 | 18/46 |
| KPORF-68 | 84 | 37/46 |
| KPORF-69 | 85 | 5/46 |
| KPORF-70 | 86 | 42/46 |
| KPORF-71 | 87 | 39/46 |
| KPORF-72 | 88 | 43/46 |
| KPORF-73 | 89 | 41/46 |
| KPORF-74 | 90 | 36/46 |
| KPORF-75 | 91 | 31/46 |
| KPORF-76 | 92 | 38/46 |
| KPORF-77 | 93 | 37/46 |
| KPORF-78 | 94 | 40/46 |
| KPORF-79 | 95 | 4/46 |
| KPORF-80 | 96 | 4/46 |
| KPORF-81 | 97 | 2/46 |
| KPORF-82 | 98 | 46/46 |
| KPARF-01 | 100 | 37/46 |
| KPARF-04 | 103 | 40/46 |
| KPARF-05 | 104 | 46/46 |
| KPARF-07 | 106 | 43/46 |
| KPARF-08 | 107 | 40/46 |
| KPCRF-01 | 147 | 39/46 |
| KPCRF-02 | 148 | 1/46 |
| KPCRF-05 | 151 | 10/46 |
| KPCRF-06 | 152 | 45/46 |
| KPCRF-07 | 153 | 44/46 |
| KPCRF-08 | 154 | 36/46 |
| KPCRF-10 | 156 | 32/46 |
| KPCRF-12 | 158 | 34/46 |

46 Klebsiella strains plus MGH78578 as a positive PCR control as shown in Table 3 were tested by PCR with oligonucleotides specific for the genes encoding relevant antigens. The gene distribution table lists the number of positive PCR results from 46 strains for each gene and is an indication of the presence and conservation of the gene in diverse isolates of Klebsiella species.

TABLE 4

Peptide ELISA with peptides derived from *K. pneumoniae* antigens

Immune reactivity of individual synthetic peptides representing selected epitopes with individual human sera is shown. Extent of reactivity is colour coded; white, < 0.05 OD units; light grey, 0.05-0.2 OD units; dark grey, 0.2-0.4 OD units; black, > 0.4 OD units. The "Sum" represents the number of sera, for which the $OD_{405\ nm}$ measurement was at least 0.05 OD units above the blank without coating. Score is calculated as the sum of all reactivities (white = 0; light grey = 1; dark grey = 2; black = 3). "From aa" and "To aa" denotes the position of the peptide relative to the full length protein as listed under the respective sequence identification number (Seq ID No). ELISA experiments were preformed with peptides derived from *K. pneumoniae* antigens and 22 high titer human sera (P3494.2, P3495.2, P3518.2, P3533.2, P3536.2, P3545, P3548, P3560, P3567, P3571, P3576, P3581, P3582, P3583, IC38, IC40, IC76, IC86, IC88, IC89, IC92 and IC93). P3494.2, P3495.2, P3518.2, P3533.2 and P3536.2 are convalescent sera.

| Peptide | ORF | Seq ID | Sum | From aa | To aa | Score |
|---|---|---|---|---|---|---|
| CRF-2.04 | KPCRF-02 | 335 | 22 | 65 | 86 | 61 |
| ORF-26.01 | KPORF-26 | 229 | 22 | 85 | 114 | 48 |
| ORF-81.01 | KPORF-81 | 284 | 22 | 212 | 244 | 27 |
| ARF-3.01 | KPARF-03 | 289 | 21 | 13 | 37 | 49 |
| ORF-58.01 | KPORF-58 | 261 | 21 | 35 | 65 | 22 |
| CRF-4.01 | KPCRF-04 | 337 | 20 | 58 | 82 | 41 |
| ORF-27.03 | KPORF-27 | 230 | 20 | 83 | 109 | 20 |
| ORF-42.01 | KPORF-42 | 245 | 20 | 248 | 276 | 23 |
| ORF-52.02 | KPORF-52 | 255 | 20 | 99 | 128 | 36 |
| ORF-80.02 | KPORF-80 | 283 | 20 | 23 | 50 | 26 |
| CRF-1.02 | KPCRF-01 | 334 | 19 | 94 | 126 | 24 |
| ORF-36.03 | KPORF-36 | 239 | 19 | 71 | 98 | 26 |
| ORF-20.03 | KPORF-20 | 223 | 18 | 77 | 107 | 22 |
| ORF-56.02 | KPORF-56 | 259 | 18 | 252 | 282 | 18 |
| ORF-58.02 | KPORF-58 | 261 | 18 | 61 | 91 | 19 |
| ORF-79.02 | KPORF-79 | 282 | 18 | 340 | 364 | 20 |
| ARF-1.02 | KPARF-01 | 287 | 17 | 59 | 82 | 21 |
| ARF-6.01 | KPARF-06 | 292 | 17 | 1 | 25 | 30 |
| ORF-47.01 | KPORF-47 | 250 | 17 | 46 | 69 | 17 |
| ORF-64.02 | KPORF-64 | 267 | 17 | 75 | 106 | 17 |
| ORF-73.02 | KPORF-73 | 276 | 17 | 117 | 140 | 20 |
| ORF-80.01 | KPORF-80 | 283 | 17 | -3 | 27 | 23 |
| ORF-81.03 | KPORF-81 | 284 | 17 | 557 | 586 | 22 |
| ORF-81.04 | KPORF-81 | 284 | 17 | 582 | 611 | 21 |
| ARF-5.01 | KPARF-05 | 291 | 16 | 19 | 42 | 18 |
| ORF-28.02 | KPORF-28 | 231 | 16 | 280 | 300 | 16 |
| ORF-37.01 | KPORF-37 | 240 | 16 | 789 | 813 | 21 |
| ORF-37.02 | KPORF-37 | 240 | 16 | 809 | 834 | 16 |
| ORF-39.01 | KPORF-39 | 242 | 16 | 160 | 188 | 17 |
| ORF-40.01 | KPORF-40 | 243 | 16 | 130 | 159 | 16 |
| ORF-41.01 | KPORF-41 | 244 | 16 | 117 | 147 | 16 |
| ORF-44.01 | KPORF-44 | 247 | 16 | 231 | 256 | 16 |
| ORF-67.01 | KPORF-67 | 270 | 16 | 126 | 151 | 16 |
| ORF-68.03 | KPORF-68 | 271 | 16 | 140 | 170 | 16 |
| ORF-82.02 | KPORF-82 | 285 | 16 | 298 | 324 | 20 |

TABLE 4-continued

Peptide ELISA with peptides derived from *K. pneumoniae* antigens

Immune reactivity of individual synthetic peptides representing selected epitopes with individual human sera is shown. Extent of reactivity is colour coded; white, < 0.05 OD units; light grey, 0.05-0.2 OD units; dark grey, 0.2-0.4 OD units; black, > 0.4 OD units. The "Sum" represents the number of sera, for which the $OD_{405\ nm}$ measurement was at least 0.05 OD units above the blank without coating. Score is calculated as the sum of all reactivities (white = 0; light grey = 1; dark grey = 2; black = 3). "From aa" and "To aa" denotes the position of the peptide relative to the full length protein as listed under the respective sequence identification number (Seq ID No). ELISA experiments were preformed with peptides derived from *K. pneumoniae* antigens and 22 high titer human sera (P3494.2, P3495.2, P3518.2, P3533.2, P3536.2, P3545, P3548, P3560, P3567, P3571, P3576, P3581, P3582, P3583, IC38, IC40, IC76, IC86, IC88, IC89, IC92 and IC93). P3494.2, P3495.2, P3518.2, P3533.2 and P3536.2 are convalescent sera.

| ORF-43.01 | KPORF-43 | 246 | 15 | 21 | 43 | 16 |
|---|---|---|---|---|---|---|
| ORF-21.02 | KPORF-21 | 224 | 15 | 42 | 66 | 15 |
| ORF-79.01 | KPORF-79 | 282 | 15 | 316 | 344 | 19 |
| ORF-82.01 | KPORF-82 | 285 | 15 | 276 | 302 | 18 |
| ARF-1.01 | KPARF-01 | 287 | 14 | 41 | 64 | 17 |
| ARF-7.01 | KPARF-07 | 293 | 14 | 30 | 54 | 15 |
| CRF-1.01 | KPCRF-01 | 334 | 14 | 67 | 98 | 17 |
| CRF-2.03 | KPCRF-02 | 335 | 14 | 46 | 70 | 16 |
| ORF-17.03 | KPORF-17 | 220 | 14 | 526 | 549 | 14 |
| ORF-20.01 | KPORF-20 | 223 | 14 | 25 | 55 | 14 |
| ORF-23.02 | KPORF-23 | 226 | 14 | 295 | 320 | 15 |
| ORF-32.01 | KPORF-32 | 235 | 14 | 158 | 182 | 14 |
| ORF-44.02 | KPORF-44 | 247 | 14 | 252 | 278 | 14 |
| ORF-46.03 | KPORF-46 | 249 | 14 | 158 | 183 | 14 |
| ORF-47.02 | KPORF-47 | 250 | 14 | 65 | 87 | 14 |
| ORF-52.01 | KPORF-52 | 255 | 14 | 74 | 103 | 14 |
| ORF-52.03 | KPORF-52 | 255 | 14 | 124 | 152 | 14 |
| ORF-57.02 | KPORF-57 | 260 | 14 | 171 | 198 | 14 |
| ORF-59.01 | KPORF-59 | 262 | 14 | 608 | 631 | 14 |
| ORF-60.01 | KPORF-60 | 263 | 14 | 124 | 149 | 15 |
| ORF-62.01 | KPORF-62 | 265 | 14 | 127 | 157 | 14 |
| ORF-62.02 | KPORF-62 | 265 | 14 | 153 | 182 | 14 |
| ORF-81.02 | KPORF-81 | 284 | 14 | 532 | 561 | 17 |
| CRF-5.03 | KPCRF-05 | 338 | 13 | 77 | 101 | 14 |
| ORF-23.01 | KPORF-23 | 226 | 13 | 274 | 299 | 15 |
| ORF-41.02 | KPORF-41 | 244 | 13 | 143 | 173 | 13 |
| ORF-66.01 | KPORF-66 | 269 | 13 | 151 | 180 | 15 |

| ARF-2.01 | KPARF-02 | 288 | 12 | 53 | 77 | 25 |
|---|---|---|---|---|---|---|
| ARF-4.02 | KPARF-04 | 290 | 12 | 90 | 114 | 16 |
| CRF-6.01 | KPCRF-06 | 339 | 12 | 37 | 68 | 13 |
| ORF-32.02 | KPORF-32 | 235 | 12 | 178 | 202 | 12 |
| ORF-45.01 | KPORF-45 | 248 | 12 | 62 | 91 | 12 |
| ORF-46.01 | KPORF-46 | 249 | 12 | 116 | 141 | 12 |
| ORF-48.02 | KPORF-48 | 251 | 12 | 138 | 163 | 12 |
| ORF-53.01 | KPORF-53 | 256 | 12 | 202 | 231 | 12 |
| ORF-68.01 | KPORF-68 | 271 | 12 | 89 | 118 | 13 |

TABLE 4-continued

Peptide ELISA with peptides derived from *K. pneumoniae* antigens

Immune reactivity of individual synthetic peptides representing selected epitopes with individual human sera is shown. Extent of reactivity is colour coded; white, < 0.05 OD units; light grey, 0.05-0.2 OD units; dark grey, 0.2-0.4 OD units; black, > 0.4 OD units. The "Sum" represents the number of sera, for which the $OD_{405\ nm}$ measurement was at least 0.05 OD units above the blank without coating. Score is calculated as the sum of all reactivities (white = 0; light grey = 1; dark grey = 2; black = 3). "From aa" and "To aa" denotes the position of the peptide relative to the full length protein as listed under the respective sequence identification number (Seq ID No). ELISA experiments were preformed with peptides derived from *K. pneumoniae* antigens and 22 high titer human sera (P3494.2, P3495.2, P3518.2, P3533.2, P3536.2, P3545, P3548, P3560, P3567, P3571, P3576, P3581, P3582, P3583, IC38, IC40, IC76, IC86, IC88, IC89, IC92 and IC93). P3494.2, P3495.2, P3518.2, P3533.2 and P3536.2 are convalescent sera.

| ID | Name | SeqID | Score | From aa | To aa | Sum |
|---|---|---|---|---|---|---|
| ORF-22.01 | KPORF-22 | 225 | 11 | 575 | 601 | 11 |
| ORF-34.02 | KPORF-34 | 237 | 11 | 575 | 605 | 11 |
| ORF-38.01 | KPORF-38 | 241 | 11 | 759 | 783 | 11 |
| ORF-41.03 | KPORF-41 | 244 | 11 | 169 | 201 | 11 |
| ORF-49.02 | KPORF-49 | 252 | 11 | 229 | 255 | 11 |
| ORF-51.03 | KPORF-51 | 254 | 11 | 141 | 167 | 11 |
| ORF-66.02 | KPORF-66 | 269 | 11 | 176 | 206 | 11 |
| CRF-10.01 | KPCRF-10 | 343 | 10 | 56 | 79 | 18 |
| ORF-1.02 | KPORF-01 | 204 | 10 | 198 | 227 | 16 |
| ORF-11.01 | KPORF-11 | 214 | 10 | 66 | 90 | 13 |
| ORF-18.01 | KPORF-18 | 221 | 10 | 416 | 442 | 10 |
| ORF-18.02 | KPORF-18 | 221 | 10 | 438 | 465 | 10 |
| ORF-21.01 | KPORF-21 | 224 | 10 | 18 | 46 | 11 |
| ORF-33.02 | KPORF-33 | 236 | 10 | 151 | 180 | 10 |
| ORF-39.03 | KPORF-39 | 242 | 10 | 207 | 232 | 20 |
| ORF-45.03 | KPORF-45 | 248 | 10 | 199 | 227 | 10 |
| ORF-57.04 | KPORF-57 | 260 | 10 | 217 | 240 | 11 |
| ORF-61.02 | KPORF-61 | 264 | 10 | 17 | 49 | 10 |
| ORF-74.02 | KPORF-74 | 277 | 10 | 93 | 117 | 10 |
| ARF-5.02 | KPARF-05 | 291 | 9 | 37 | 60 | 10 |
| ARF-9.01 | KPARF-09 | 295 | 9 | 25 | 54 | 12 |
| ORF-19.02 | KPORF-19 | 222 | 9 | 217 | 240 | 9 |
| ORF-19.03 | KPORF-19 | 222 | 9 | 235 | 257 | 9 |
| ORF-25.02 | KPORF-25 | 228 | 9 | 287 | 313 | 9 |
| ORF-39.02 | KPORF-39 | 242 | 9 | 184 | 211 | 9 |
| ORF-45.02 | KPORF-45 | 248 | 9 | 87 | 115 | 9 |
| ORF-61.01 | KPORF-61 | 264 | 9 | -14 | 21 | 10 |

| ID | Name | SeqID | Score | From aa | To aa | Sum |
|---|---|---|---|---|---|---|
| ORF-7.02 | KPORF-07 | 210 | 9 | 115 | 139 | 10 |
| ORF-77.01 | KPORF-77 | 280 | 9 | 240 | 271 | 9 |
| ORF-78.01 | KPORF-78 | 281 | 9 | 165 | 188 | 9 |
| ARF-8.01 | KPARF-08 | 294 | 8 | 111 | 135 | 8 |
| ORF-13.05 | KPORF-13 | 216 | 8 | 236 | 261 | 9 |
| ORF-24.01 | KPORF-24 | 227 | 8 | 32 | 61 | 8 |
| ORF-6.03 | KPORF-06 | 209 | 8 | 62 | 85 | 8 |
| ORF-9.01 | KPORF-09 | 212 | 8 | 10 | 35 | 9 |
| ORF-9.03 | KPORF-09 | 212 | 8 | 52 | 77 | 8 |
| ORF-1.01 | KPORF-01 | 204 | 7 | 179 | 208 | 7 |
| ORF-10.01 | KPORF-10 | 213 | 7 | 382 | 407 | 8 |
| ORF-23.03 | KPORF-23 | 226 | 7 | 316 | 339 | 7 |
| ORF-31.03 | KPORF-31 | 234 | 7 | 370 | 401 | 7 |
| ORF-34.01 | KPORF-34 | 237 | 7 | 549 | 579 | 7 |
| ORF-51.02 | KPORF-51 | 254 | 7 | 120 | 145 | 7 |
| ORF-6.02 | KPORF-06 | 209 | 7 | 45 | 67 | 7 |
| ORF-7.03 | KPORF-07 | 210 | 7 | 134 | 158 | 9 |
| ORF-74.03 | KPORF-74 | 277 | 7 | 113 | 137 | 7 |
| CRF-11.01 | KPCRF-11 | 344 | 6 | 77 | 101 | 6 |
| CRF-3.02 | KPCRF-03 | 336 | 6 | 20 | 44 | 7 |
| CRF-8.01 | KPCRF-08 | 341 | 6 | 140 | 164 | 6 |
| CRF-9.01 | KPCRF-09 | 342 | 6 | 13 | 40 | 6 |
| CRF-9.03 | KPCRF-09 | 342 | 6 | 55 | 79 | 8 |
| ORF-15.01 | KPORF-15 | 218 | 6 | 13 | 37 | 8 |
| ORF-15.02 | KPORF-15 | 218 | 6 | 33 | 56 | 6 |
| ORF-30.01 | KPORF-30 | 233 | 6 | 404 | 429 | 6 |
| ORF-4.02 | KPORF-04 | 207 | 6 | 226 | 249 | 6 |

TABLE 4-continued

*Peptide ELISA with peptides derived from K. pneumoniae antigens*

Immune reactivity of individual synthetic peptides representing selected epitopes with individual human sera is shown. Extent of reactivity is colour coded; white, < 0.05 OD units; light grey, 0.05-0.2 OD units; dark grey, 0.2-0.4 OD units; black, > 0.4 OD units. The "Sum" represents the number of sera, for which the $OD_{405\,nm}$ measurement was at least 0.05 OD units above the blank without coating. Score is calculated as the sum of all reactivities (white = 0; light grey = 1; dark grey = 2; black = 3). "From aa" and "To aa" denotes the position of the peptide relative to the full length protein as listed under the respective sequence identification number (Seq ID No). ELISA experiments were preformed with peptides derived from *K. pneumoniae* antigens and 22 high titer human sera (P3494.2, P3495.2, P3518.2, P3533.2, P3536.2, P3545, P3548, P3560, P3567, P3571, P3576, P3581, P3582, P3583, IC38, IC40, IC76, IC86, IC88, IC89, IC92 and IC93). P3494.2, P3495.2, P3518.2, P3533.2 and P3536.2 are convalescent sera.

| ORF-42.03 | KPORF-42 | 245 | 6 | 296 | 323 | | 6 |
| ORF-68.02 | KPORF-68 | 271 | 6 | 114 | 144 | | 6 |
| ORF-69.01 | KPORF-69 | 272 | 6 | 80 | 112 | | 8 |
| ORF-7.01 | KPORF-07 | 210 | 6 | 96 | 120 | | 7 |
| ORF-78.02 | KPORF-78 | 281 | 6 | 183 | 206 | | 8 |
| ORF-8.02 | KPORF-08 | 211 | 6 | 539 | 563 | | 6 |
| ORF-9.02 | KPORF-09 | 212 | 6 | 31 | 56 | | 6 |
| CRF-10.02 | KPCRF-10 | 343 | 5 | 75 | 101 | | 5 |
| CRF-12.01 | KPCRF-12 | 345 | 5 | 94 | 118 | | 6 |

| CRF-5.01 | KPCRF-05 | 338 | 5 | 37 | 62 | | 6 |
| CRF-9.02 | KPCRF-09 | 342 | 5 | 36 | 60 | | 5 |
| ORF-14.02 | KPORF-14 | 217 | 5 | 128 | 153 | | 5 |
| ORF-16.03 | KPORF-16 | 219 | 5 | 172 | 195 | | 5 |
| ORF-18.03 | KPORF-18 | 221 | 5 | 461 | 489 | | 5 |
| ORF-2.01 | KPORF-02 | 205 | 5 | 45 | 69 | | 5 |
| ORF-2.03 | KPORF-02 | 205 | 5 | 83 | 106 | | 5 |
| ORF-28.01 | KPCRF-28 | 231 | 5 | 264 | 285 | | 7 |
| ORF-29.01 | KPORF-29 | 232 | 5 | 102 | 128 | | 7 |
| ORF-35.02 | KPORF-35 | 238 | 5 | 19 | 46 | | 6 |
| ORF-4.01 | KPORF-04 | 207 | 5 | 209 | 230 | | 5 |
| ORF-5.01 | KPORF-05 | 208 | 5 | -9 | 15 | | 5 |
| ORF-5.02 | KPORF-05 | 208 | 5 | 10 | 33 | | 5 |
| ORF-51.01 | KPORF-51 | 254 | 5 | 99 | 124 | | 5 |
| ORF-67.03 | KPORF-67 | 270 | 5 | 167 | 190 | | 6 |
| ORF-8.01 | KPORF-08 | 211 | 5 | 519 | 543 | | 5 |
| ORF-8.03 | KPORF-08 | 211 | 5 | 559 | 584 | | 5 |
| CRF-3.01 | KPCRF-03 | 336 | 4 | 1 | 24 | | 4 |
| CRF-7.02 | KPCRF-07 | 340 | 4 | 343 | 375 | | 6 |
| ORF-13.01 | KPORF-13 | 216 | 4 | 56 | 85 | | 4 |
| ORF-15.03 | KPORF-15 | 218 | 4 | 52 | 76 | | 4 |
| ORF-17.01 | KPORF-17 | 220 | 4 | 489 | 512 | | 4 |
| ORF-19.01 | KPORF-19 | 222 | 4 | 199 | 222 | | 4 |
| ORF-25.01 | KPORF-25 | 228 | 4 | 266 | 291 | | 4 |
| ORF-34.03 | KPORF-34 | 237 | 4 | 601 | 630 | | 5 |
| ORF-35.01 | KPORF-35 | 238 | 4 | -7 | 23 | | 4 |
| ORF-4.03 | KPORF-04 | 207 | 4 | 245 | 269 | | 4 |

TABLE 4-continued

*Peptide ELISA with peptides derived from K. pneumoniae antigens*

Immune reactivity of individual synthetic peptides representing selected epitopes with individual human sera is shown. Extent of reactivity is colour coded; white, < 0.05 OD units; light grey, 0.05-0.2 OD units; dark grey, 0.2-0.4 OD units; black, > 0.4 OD units. The "Sum" represents the number of sera, for which the $OD_{405\,nm}$ measurement was at least 0.05 OD units above the blank without coating. Score is calculated as the sum of all reactivities (white = 0; light grey = 1; dark grey = 2; black = 3). "From aa" and "To aa" denotes the position of the peptide relative to the full length protein as listed under the respective sequence identification number (Seq ID No). ELISA experiments were preformed with peptides derived from *K. pneumoniae* antigens and 22 high titer human sera (P3494.2, P3495.2, P3518.2, P3533.2, P3536.2, P3545, P3548, P3560, P3567, P3571, P3576, P3581, P3582, P3583, IC38, IC40, IC76, IC86, IC88, IC89, IC92 and IC93). P3494.2, P3495.2, P3518.2, P3533.2 and P3536.2 are convalescent sera.

| ORF | KPORF | SeqID | Score | From aa | To aa | Sum |
|---|---|---|---|---|---|---|
| ORF-5.03 | KPORF-05 | 208 | 4 | 28 | 52 | 5 |
| ORF-50.01 | KPORF-50 | 253 | 4 | 61 | 88 | 4 |
| ORF-53.02 | KPORF-53 | 256 | 4 | 227 | 256 | 6 |
| ORF-56.01 | KPORF-56 | 259 | 4 | 226 | 256 | 4 |
| ORF-64.01 | KPORF-64 | 267 | 4 | 48 | 79 | 4 |
| ARF-7.02 | KPARF-07 | 293 | 3 | 50 | 75 | 5 |
| CRF-5.02 | KPCRF-05 | 338 | 3 | 58 | 82 | 3 |
| ORF-2.02 | KPORF-02 | 205 | 3 | 65 | 89 | 3 |
| ORF-24.02 | KPORF-24 | 227 | 3 | 57 | 85 | 3 |
| ORF-27.01 | KPORF-27 | 230 | 3 | 36 | 64 | 3 |
| ORF-36.02 | KPORF-36 | 239 | 3 | 48 | 75 | 3 |
| ORF-46.02 | KPORF-46 | 249 | 3 | 137 | 162 | 3 |
| ORF-65.02 | KPORF-65 | 268 | 3 | 435 | 466 | 6 |
| ORF-76.01 | KPORF-76 | 279 | 3 | 271 | 300 | 3 |
| ORF-83.01 | KPORF-83 | 286 | 3 | 335 | 364 | 3 |
| ARF-4.01 | KPARF-04 | 290 | 2 | 69 | 94 | 2 |
| CRF-2.02 | KPCRF-02 | 335 | 2 | 27 | 51 | 2 |
| ORF-12.02 | KPORF-12 | 215 | 2 | 61 | 88 | 2 |
| ORF-16.01 | KPORF-16 | 219 | 2 | 132 | 156 | 2 |
| ORF-17.02 | KPORF-17 | 220 | 2 | 508 | 531 | 2 |
| ORF-29.02 | KPORF-29 | 232 | 2 | 124 | 152 | 2 |
| ORF-3.01 | KPORF-03 | 206 | 2 | 269 | 290 | 2 |
| ORF-30.03 | KPORF-30 | 233 | 2 | 445 | 468 | 2 |
| ORF-48.01 | KPORF-48 | 251 | 2 | 117 | 142 | 4 |
| ORF-49.01 | KPORF-49 | 252 | 2 | 208 | 233 | 2 |
| ORF-83.02 | KPORF-83 | 286 | 2 | 360 | 389 | 2 |
| CRF-2.01 | KPCRF-02 | 335 | 1 | 9 | 32 | 1 |

| ORF | KPORF | SeqID | Score | From aa | To aa | Sum |
|---|---|---|---|---|---|---|
| CRF-6.02 | KPCRF-06 | 339 | 1 | 64 | 93 | 2 |
| CRF-7.01 | KPCRF-07 | 340 | 1 | 317 | 347 | 1 |
| ORF-10.02 | KPORF-10 | 213 | 1 | 403 | 428 | 1 |
| ORF-12.01 | KPORF-12 | 215 | 1 | 38 | 65 | 1 |
| ORF-13.03 | KPORF-13 | 216 | 1 | 198 | 221 | 1 |
| ORF-13.04 | KPORF-13 | 216 | 1 | 217 | 240 | 1 |
| ORF-14.01 | KPORF-14 | 217 | 1 | 108 | 132 | 1 |
| ORF-15.04 | KPORF-15 | 218 | 1 | 175 | 200 | 1 |
| ORF-15.05 | KPORF-15 | 218 | 1 | 196 | 220 | 1 |

| ORF | KPORF | SeqID | Score | From aa | To aa | Sum |
|---|---|---|---|---|---|---|
| ORF-16.02 | KPORF-16 | 219 | 1 | 152 | 176 | 1 |
| ORF-20.02 | KPORF-20 | 223 | 1 | 51 | 81 | 1 |
| ORF-22.02 | KPORF-22 | 225 | 1 | 597 | 623 | 1 |
| ORF-31.02 | KPORF-31 | 234 | 1 | 343 | 374 | 1 |
| ORF-42.02 | KPORF-42 | 245 | 1 | 272 | 300 | 2 |
| ORF-47.03 | KPORF-47 | 250 | 1 | 82 | 105 | 1 |
| ORF-52.04 | KPORF-52 | 255 | 1 | 148 | 176 | 1 |
| ORF-54.01 | KPORF-54 | 257 | 1 | 129 | 154 | 1 |
| ORF-54.02 | KPORF-54 | 257 | 1 | 150 | 178 | 1 |
| ORF-55.02 | KPORF-55 | 258 | 1 | 95 | 126 | 1 |
| ORF-57.03 | KPORF-57 | 260 | 1 | 194 | 221 | 1 |
| ORF-6.01 | KPORF-06 | 209 | 1 | 29 | 50 | 1 |
| ORF-63.02 | KPORF-63 | 266 | 1 | 150 | 176 | 1 |
| ORF-71.01 | KPORF-71 | 274 | 1 | 9 | 36 | 1 |
| ORF-74.01 | KPORF-74 | 277 | 1 | 72 | 97 | 1 |
| ORF-75.01 | KPORF-75 | 278 | 1 | 723 | 746 | 1 |
| ORF-77.02 | KPORF-77 | 280 | 1 | 267 | 296 | 1 |

TABLE 5

Surface staining with epitope sera generated in mice.

| ORF | Seq ID NO (Protein) | Location in protein (aa) | A5054 | Friedländer 204 |
|---|---|---|---|---|
| KPORF-02 | 205 | 46-105 | +++ | ++ |
| KPORF-13 | 216 | 56-111 | ++ | +++ |
| KPORF-20 | 223 | 25-107 | + | +++ |
| KPORF-21 | 224 | 19-66 | ++ | ++ |
| KPORF-26 | 229 | 85-114 | + | ++ |
| KPORF-27 | 230 | 37-109 | + | ++ |
| KPORF-28 | 231 | 266-296 | + | ++ |
| KPORF-29 | 232 | 103-152 | + | +++ |
| KPORF-32 | 235 | 167-218 | + | +++ |
| KPORF-37 | 240 | 790-834 | + | +++ |
| KPORF-38 | 241 | 761-781 | ++ | +++ |
| KPORF-39 | 242 | 176-232 | ++ | +++ |
| KPORF-41 | 244 | 117-201 | + | ++ |
| KPORF-42 | 245 | 249-323 | + | ++ |
| KPORF-44 | 247 | 232-278 | + | ++ |
| KPORF-49 | 252 | 209-255 | + | +++ |
| KPORF-52 | 255 | 75-176 | + | ++ |
| KPORF-53 | 256 | 202-256 | + | ++ |
| KPORF-54 | 257 | 130-178 | + | ++ |
| KPORF-55 | 258 | 69-126 | ++ | +++ |
| KPORF-60 | 263 | 126-148 | + | ++ |
| KPORF-61 | 264 | 1-49 | + | ++ |
| KPORF-62 | 265 | 127-182 | + | ++ |
| KPORF-64 | 267 | 48-106 | + | ++ |
| KPORF-65 | 268 | 410-466 | + | +++ |
| KPORF-66 | 269 | 152-206 | ++ | +++ |
| KPORF-72 | 275 | 555-621 | + | ++ |
| KPORF-78 | 281 | 166-202 | ++ | +++ |
| KPORF-79 | 282 | 317-364 | + | ++ |
| KPORF-80 | 283 | 1-50 | + | ++ |
| KPORF-82 | 285 | 277-324 | ++ | +++ |
| KPARF-03 | 289 | 14-36 | ++ | +++ |
| KPCRF-03 | 336 | 6-43 | ++ | +++ |
| KPCRF-10 | 343 | 57-101 | ++ | ++ |
| KPCRF-11 | 344 | 84-95 | +++ | +++ |
| KPCRF-12 | 345 | 98-115 | + | +++ |

The epitope specific antibodies generated in mice were tested in FACS analysis for binding to the surface of K. pneumoniae strain A5054 and Friedländer 204 cells.
The sera that showed a significant shift in FACS analysis are listed.
The extent of the shift is indicated by the number of "+"; +, 0-9%; ++, 10-35%, +++, >36%.
The percentage indicates the number of cells that showed a shift in the FACS analysis in comparison to cells incubated without immune sera.

TABLE 6

Klebsiella sp. strains utilized for the gene conservation analyses of Klebsiella pneumoniae antigens.

| Number | Strain name | Species | K-Type | O-Type |
|---|---|---|---|---|
| 1 | A 5054 | K. pneumoniae | 1 | 1 |
| 2 | i252/94 | K. pneumoniae | 1 | 3 |
| 3 | B 5055 | K. pneumoniae | 2 | 1 |
| 4 | i225/94 | K. pneumoniae | 3 | 1 |
| 5 | D 5050 | K. ozaenae | 4 | 2ac |
| 6 | E 5051 | K. ozaenae | 5 | 2ac |
| 7 | Aerogenes4140 | K. pneumoniae | 7 | 1 |
| 8 | 1015 | K. planticola | 8 | 1 |
| 9 | i262/94 | K. pneumoniae | 9 | 3 |
| 10 | 919 | K. pneumoniae | 10 | 1 |
| 11 | 313 | K. pneumoniae | 12 | 1 |
| 12 | 1470 | K. pneumoniae | 13 | O− |
| 13 | 1193 | K. planticola | 14 | 5 |
| 14 | Mich61 | K. pneumoniae | 15 | 4 |
| 15 | 2069/49 | K. pneumoniae | 16 | 1 |
| 16 | i243/94 | K. pneumoniae | 16 | 3 |
| 17 | 2005/49 | K. pneumoniae | 17 | O− |
| 18 | 1754/49 | K. pneumoniae | 18 | 1 |
| 19 | 1702/49 | K. pneumoniae | 21 | 1 |
| 20 | i202/94 | K. pneumoniae | 21 | 3 |
| 21 | 1996/49 | K. pneumoniae | 22 | 1 |
| 22 | 1680/49 | K. pneumoniae | 24 | 1 |
| 23 | 2002/49 | K. pneumoniae | 25 | 3 |
| 24 | 6613 | K. pneumoniae | 27 | 2 |
| 25 | 5758 | K. pneumoniae | 28 | 2 |
| 26 | 5725y | K. oxytoca | 29 | 1 |
| 27 | 7824 | K. pneumoniae | 30 | 1 |
| 28 | 6258 | K. pneumoniae | 31 | 3 |
| 29 | 6168 | K. pneumoniae | 33 | 3 |
| 30 | i256/94 | K. pneumoniae | 38 | 3 |
| 31 | 7749 | K. planticola | 39 | 1 |
| 32 | 2482 | K. pneumoniae | 43 | 2 |
| 33 | 5281 | K. pneumoniae | 46 | 1 |
| 34 | i224/94 | K. pneumoniae | 52 | 3 |
| 35 | 1756/51 | K. planticola | 53 | 3 |
| 36 | Stanley | K. planticola | 54 | 3 |
| 37 | 3985/51 | K. pneumoniae | 55 | 3 |
| 38 | i221/94 | K. pneumoniae | 57 | 3 |
| 39 | 4463/52 | K. pneumoniae | 60 | 5 |
| 40 | 5710/52 | K. pneumoniae | 61 | 5 |
| 41 | 5711/52 | K. pneumoniae | 62 | 1 |
| 42 | 5845/52 | K. pneumoniae | 63 | 1 |
| 43 | NCTC8172 | K. pneumoniae | 64 | 1 |
| 44 | 264-1 | K. pneumoniae | 67 | 7 |
| 45 | 265-1 | K. pneumoniae | 68 | 2 |
| 46 | 889 | K. pneumoniae | 69 | 8 |
| 47 | 708 | K. pneumoniae | 80 | 12 |
| 48 | 370 | K. pneumoniae | 81 | O+ |
| 49 | Friedländer 204 | K. pneumoniae | K− | 1 |
| 50 | 5053 | K. ozaenae | K− | 2a, 2c |
| 51 | MGH78578 | K. pneumoniae | nd | nd |

TABLE 7

Oligonucleotides used for sequence conservation analyses. Shown are the KPORFs and primer names, SEQ ID NOs, orientation of the primer relative to the gene, the sequence, and the position relative to the gene. Oligonucleotides were used for both PCR amplification of the gene or gene fragment and subsequent sequence analyses.

| ORF | Primer name | Orientation | Sequence | Position relative to gene start |
|---|---|---|---|---|
| KPORF-13 | 210-5901 (SEQ ID NO 377) | sense | GTGCTGGCGGTTATCCTG | −83 to −66 |
|  | 210-5902 (SEQ ID NO 378) | antisense | GTTATTCCCGGGTCGAAATC | +1145 to 1164 |

TABLE 7-continued

Oligonucleotides used for sequence conservation analyses. Shown are
the KPORFs and primer names, SEQ ID NOs, orientation of the primer
relative to the gene, the sequence, and the position relative to
the gene. Oligonucleotides were used for both PCR amplification
of the gene or gene fragment and subsequent sequence analyses.

| ORF | Primer name | Orientation | Sequence | Position relative to gene start |
|---|---|---|---|---|
| KPORF-21 | 210-5903 (SEQ ID NO 379) | sense | ACGCAGAAGAAACCGAACAG | −89 to −70 |
| | 210-5904 (SEQ ID NO 380) | antisense | CGACGGAATAAAGTGGGAAT | +549 to +568 |
| KPORF-32 | 210-6097 (SEQ ID NO 381) | sense | GACCAGAGTGAAATATTTACAAAA | −52 to −29 |
| | 210-6563 (SEQ ID NO 382) | antisense | GTTTATCGCCACGCTGAT | +1295 to +1312 |
| KPORF-37 | 210-5905 (SEQ ID NO 383) | sense | GCCTGATGGCTGAATCGTTA | −54 to −35 |
| | 210-5906 (SEQ ID NO 384) | antisense | GAGCAGCGTTTTGTTGTCG | +1089 to +1107 |
| | 210-6345 (SEQ ID NO 385) | sense | CAAGCTGAAGCTGTTGGGTGTGGAC | +963 to 987 |
| | 210-6346 (SEQ ID NO 386) | antisense | GGCGGTGCGGATGTAGAACATC | +2211 to 2232 |
| | 210-5909 (SEQ ID NO 387) | sense | GGCTGGAACCTGTACGTTTG | +2101 to 2120 |
| | 210-5910 (SEQ ID NO 388) | antisense | TCGTCGATGCTGCAGATATT | +2556 to 2575 |
| KPORF-38 | 210-5911 (SEQ ID NO 389) | sense | CCGCTTCGTCACTGTTGAG | −44 to −26 |
| | 210-5912 (SEQ ID NO 390) | antisense | TGACTGACAAAGGCGGAGAG | +652 to +671 |
| | 210-5913 (SEQ ID NO 391) | sense | CGCTGAACGTCGATAATGTC | +599 to +618 |
| | 210-5914 (SEQ ID NO 392) | antisense | GAACCACCTCGAGTTTCACC | +1296 to +1315 |
| | 210-5915 (SEQ ID NO 393) | sense | CGCGCGATCTCTATCGTC | +1211 to +1228 |
| | 210-5916 (SEQ ID NO 394) | antisense | GAGACCGGAGATCGCTTTTT | +2009 to +2028 |
| | 210-5917 (SEQ ID NO 395) | sense | GCCGCGTTTGATATCGTCTA | +1969 to +1988 |
| | 210-5918 (SEQ ID NO 396) | antisense | CGTTTTAACTCGTCGCCATC | +2881 to +2900 |
| | 210-5919 (SEQ ID NO 397) | sense | GTGGATAGCGGGGTACTGAA | +2728 to +2747 |
| | 210-2920 (SEQ ID NO 398) | antisense | GCCCCTCTCTATCCCATAGC | +3756 to +3775 |
| | 210-5921 (SEQ ID NO 399) | sense | TAAAGGCGCTGGGCATTAG | +3650 to +3668 |
| | 210-5922 (SEQ ID NO 400) | antisense | GGCTGACTGCCGGTATTACT | +4459 to +4478 |
| | 210-5923 (SEQ ID NO 401) | sense | AACCAACGCCTTGTTCCTT | +4311 to +4329 |
| | 210-5924 (SEQ ID NO 402) | antisense | GTGACCGGATAACGCCAGAC | +5176 to +5195 |
| KPORF-39 | 210-5925 (SEQ ID NO 403) | sense | GTAAGGACATGCAGGAGATG | −132 to −113 |
| | 210-5926 (SEQ ID NO 404) | antisense | GTAATATGGCGACGGTCTT | +892 to +910 |
| KPORF-60 | 210-5927 (SEQ ID NO 405) | sense | CATTAGGCTAGTCGTTCTCG | −54 to −35 |
| | 210-5928 (SEQ ID NO 406) | antisense | TACGTTCCTGTTACCGTGTC | +851 to +870 |
| KPORF-65 | 210-6564 (SEQ ID NO 407) | sense | GACGTCAGTTTACTGGTAGGC | −206 to −186 |
| | 210-6565 (SEQ ID NO 408) | antisense | TCTTTCAGCTGACGAATGAC | +703 to +722 |
| | 210-6566 (SEQ ID NO 409) | sense | CTCGTAATAACGCTCTATACCC | +624 to +645 |
| | 210-6567 (SEQ ID NO 410) | antisense | CAATAGCCGGAATGGATA | +1518 to +1535 |

TABLE 7-continued

Oligonucleotides used for sequence conservation analyses. Shown are the KPORFs and primer names, SEQ ID NOs, orientation of the primer relative to the gene, the sequence, and the position relative to the gene. Oligonucleotides were used for both PCR amplification of the gene or gene fragment and subsequent sequence analyses.

| ORF | Primer name | Orientation | Sequence | Position relative to gene start |
|---|---|---|---|---|
| | 210-6568 (SEQ ID NO 411) | sense | CTGATGATCCTGATTAACGAC | +1405 to +1425 |
| | 210-6569 (SEQ ID NO 412) | antisense | CGATTTTACGCTCCATCAT | +2034 to +2052 |

TABLE 8

Gene conservation of KPORF-13.

| Reference position | Alignment position | Amino acid in Reference | AA change[1] | AA change[2] | AA change[3] | AA change[4] | Strains with respective change[1] | Strains with respective change[2] | Strains with respective change[3] | Strains with respective change[4] |
|---|---|---|---|---|---|---|---|---|---|---|
| 2 | 2 | K | N | R | S | T | 313, i202/94, 6613, 5758, 4463/52 | 1680/49 | 1470 | i221/94 |
| 3 | 3 | M | L | V | | | D5050 | 1470 | | |
| 4 | 4 | K | I | N | | | D5050 | 1470, i221/94 | | |
| 5 | 5 | L | F | | | | 1470, i221/94 | | | |
| 6 | 6 | T | P | | | | 1470, i221/94 | | | |
| 7 | 7 | A | T | | | | i202/94 | | | |
| 10 | 10 | S | I | | | | 1470, i221/94 | | | |
| 11 | 11 | G | V | | | | 1470, 1680/49, i221/94 | | | |
| 12 | 12 | M | I | | | | A5054, 919, Mich61, 2069/49, i224/94, 5710/52, 708, 370, 5053 | | | |
| 13 | 13 | I | M | | | | i202/94, 4463/52 | | | |
| 14 | 14 | L | P | | | | i221/94 | | | |
| 15 | 15 | S | A | | | | i202/94, 6613, 5758, 4463/52 | | | |
| 17 | 17 | S | L | | | | 919 | | | |
| 18 | 18 | A | P | | | | 919, 5281 | | | |
| 24 | 24 | T | V | | | | 6613, 5758 | | | |
| 27 | 27 | D | E | | | | 6613, 5758 | | | |
| 29 | 29 | M | L | | | | 4463/52 | | | |
| 30 | 30 | V | D | | | | 6613, 4463/52 | | | |
| 56 | 56 | A | T | | | | Aerogenes4140, 1470, 1996/49, 5711/52 | | | |
| 84 | 84 | D | N | | | | 1754/49 | | | |
| 88 | 88 | R | H | | | | 1680/49, 5281 | | | |
| 95 | 95 | K | Q | | | | 919, 1754/49, i202/94, 1680/49, 5281, i224/94, 4463/52 | | | |
| 107 | 107 | D | A | | | | D5050, E5051, Aerogenes4140, 1470, Mich61, 1754/49, i202/94, 1996/49, 6613, 5758, 7749, i224/94, 4463/52, 5711/52, 5053 | | | |
| 122 | 122 | N | D | | | | i202/94, 4463/52 | | | |
| 125 | 125 | N | Y | | | | 2005/49, Friedländer 204 | | | |
| 183 | 183 | A | T | | | | 2005/49, Friedländer 204 | | | |
| 249 | 249 | K | Q | | | | i202/94, 4463/52 | | | |
| 260 | 260 | K | Q | | | | 6613, 5758 | | | |
| 261 | 261 | P | S | | | | 4463/52 | | | |
| 330 | 330 | V | I | L | | | NCTC8172 | i202/94, 6613, 5758, 4463/52 | | |
| 331 | 331 | L | V | | | | 1680/49 | | | |
| 333 | 333 | N | H | | | | 6613, 5758 | | | |
| 337 | 337 | V | A | | | | 1680/49 | | | |
| 338 | 338 | D | I | | | | 1680/49 | | | |
| 340 | 340 | L | V | | | | 1680/49 | | | |
| 341 | 341 | F | V | | | | 1680/49 | | | |

TABLE 8-continued

Gene conservation of KPORF-13.

| Reference position | Alignment position | Amino acid in Reference | AA change[1] | AA change[2] | AA change[3] | AA change[4] | Strains with respective change[1] | Strains with respective change[2] | Strains with respective change[3] | Strains with respective change[4] |
|---|---|---|---|---|---|---|---|---|---|---|
| 344 | 344 | F | L | | | | 6613 | | | |
| 346 | 346 | D | A | | | | 1470, 1680/49, 6613 | | | |
| 351 | 351 | F | L | | | | 1680/49 | | | |
| 352 | 352 | L | G | R | | | 1680/49, i221/94 | 6613 | | |
| 353 | 353 | D | H | N | | | 5281 | 1680/49 | | |
| 355 | 355 | K | I | N | | | 1680/49 | 5281 | | |
| 356 | 356 | R | H | L | Q | | A5054, D5050, E5051, 919, 1754/49, 6168, 7749 | 1470, 1680/49, i221/94 | i225/94, Aerogenes4140, 2005/49, 1702/49, 1996/49, 2002/49, 6613, 5758, 7824, 6258, 3985/51, 5711/52, 708, 370, Friedländer 204 | |

[1,2,3,4] observed amino acid at respective position in any of the sequenced genes of the respective *Klebsiella* sp. strains in reference to *Klebsiella pneumoniae* MGH78578.

TABLE 9

Gene conservation of KPORF-21.

| Reference position | Alignment position | Amino acid in Reference | AA change[1] | AA change[2] | AA change[3] | AA change[4] | Strains with respective change[1] | Strains with respective change[2] | Strains with respective change[3] | Strains with respective change[4] |
|---|---|---|---|---|---|---|---|---|---|---|
| 1 | 1 | V | L | | | | 5725y, 264-1 | | | |
| 2 | 2 | P | T | | | | 264-1 | | | |
| 5 | 5 | E | D | | | | B5055, 2005/49, 1702/49, 7824, i224/94 | | | |
| 6 | 6 | P | A | S | T | | 7824 | 265-1, 889 | 5725y, 264-1 | |
| 7 | 7 | S | T | | | | 889 | | | |
| 12 | 12 | G | D | | | | 5725y, 264-1 | | | |
| 36 | 36 | R | G | | | | i262/94 | | | |
| 39 | 39 | V | A | D | | | i262/94, i202/94, 5725y, Stanley, 4463/52, 264-1, 265-1, 889 | 5710/52 | | |
| 43 | 43 | M | I | | | | 2005/49 | | | |
| 44 | 44 | S | G | | | | 265-1, 889 | | | |
| 52 | 52 | D | N | | | | 5725y | | | |
| 53 | 53 | V | A | | | | 919, 313, 6613, 5758, 6258, 6168, 3985/51, i221/94, 5845/52 | | | |
| 54 | 54 | T | I | | | | 4463/52 | | | |
| 56 | 56 | D | E | | | | i262/94, i202/94, 5725y, 1756/51, Stanley, 4463/52, 264-1, 265-1, 889 | | | |
| 58 | 58 | L | V | | | | 5725y, 264-1, 265-1, 889 | | | |
| 59 | 59 | E | D | | | | 5725y, 264-1, 265-1, 889 | | | |
| 60 | 60 | Q | K | N | R | | 264-1 | | 5725y | 265-1, 889 |
| 63 | 63 | A | E | | | | 5725y, 264-1 | | | |
| 68 | 68 | N | K | | | | 2005/49 | | | |
| 74 | 74 | N | E | H | Q | | 5725y, 264-1 | | 1756/51, Stanley | 265-1, 889 |
| 78 | 78 | G | R | | | | 5725y, 264-1, 265-1, 889 | | | |
| 85 | 85 | S | G | | | | i262/94 | | | |
| 94 | 94 | I | V | | | | 5725y, 264-1 | | | |
| 99 | 99 | S | K | N | | | 5725y, 264-1 | | 265-1, 889 | |
| 104 | 104 | A | S | | | | 5725y, 264-1 | | | |
| 106 | 106 | Q | E | | | | 5725y, 264-1, 265-1, 889 | | | |
| 107 | 107 | V | A | D | E | T | i202/94, 2482, 4463/52 | | 1756/51, Stanley | 265-1, 889 | 5725y, 264-1 |
| 108 | 108 | V | G | I | T | | 265-1, 889 | | 5725y | 264-1 |
| 109 | 109 | D | E | | | | i202/94, 5725y, 2482, Stanley, 4463/52, 264-1, 265-1, 889 | | | |
| 110 | 110 | Q | A | R | | | 5725y, 264-1 | | 265-1, 889 | |
| 114 | 114 | E | K | | | | A5054, Mich61, 6613, 5758, 5845/52, 708, 370, 5053 | | | |
| 116 | 116 | D | E | | | | 5725y, 264-1, 265-1, 889 | | | |
| 118 | 118 | D | Y | | | | 5710/52 | | | |
| 120 | 120 | V | A | | | | 5725y, 264-1, 265-1, 889 | | | |
| 121 | 121 | S | L | Q | R | | 265-1, 889 | | 5725y | 264-1 |
| 122 | 122 | L | F | | | | B5055 | | | |

TABLE 9-continued

Gene conservation of KPORF-21.

| Reference position | Alignment position | Amino acid in Reference | AA change[1] | AA change[2] | AA change[3] | AA change[4] | Strains with respective change[1] | Strains with respective change[2] | Strains with respective change[3] | Strains with respective change[4] |
|---|---|---|---|---|---|---|---|---|---|---|
| 124 | 124 | R | K | | | | 5725y, 264-1, 265-1, 889 | | | |
| 125 | 125 | E | A | | | | i202/94, 4463/52 | | | |
| 133 | 133 | E | D | | | | 265-1, 889 | | | |
| 137 | 137 | S | T | | | | 5725y, 265-1, 889 | | | |
| 138 | 138 | A | V | | | | 5725y, 264-1, 265-1, 889 | | | |
| 140 | 140 | T | A | | | | i202/94, 5725y, 4463/52, 264-1, 265-1, 889 | | | |
| 145 | 145 | V | I | | | | i202/94, 5725y, 4463/52, 264-1, 265-1, 889 | | | |

[1,2,3,4] observed amino acid at respective position in any of the sequenced genes of the respective *Klebsiella* sp. strains in reference to *Klebsiella pneumoniae* MGH78578.

TABLE 10

Gene conservation of KPORF-32.

| Reference position | Alignment position | Amino acid in Reference | AA change[1] | AA change[2] | AA change[3] | Strains with respective change[1] | Strains with respective change[2] | Strains with respective change[3] |
|---|---|---|---|---|---|---|---|---|
| 2 | 2 | E | V | | | A5054, 6613 | | |
| 4 | 4 | F | I | | | 6613 | | |
| 7 | 7 | I | V | | | A5054, B5055, 6613, 5281 | | |
| 9 | 9 | V | I | | | 4463/52 | | |
| 11 | 11 | A | D | | | i243/94 | | |
| 12 | 12 | G | R | | | i243/94 | | |
| 19 | 19 | A | T | | | i243/94 | | |
| 20 | 20 | A | P | | | i243/94 | | |
| 21 | 21 | Q | D | H | | i243/94 | i221/94, 5053 | |
| 24 | 24 | Q | P | | | i243/94 | | |
| 28 | 28 | R | H | | | 5845/52 | | |
| 32 | 32 | L | V | | | i243/94 | | |
| 34 | 34 | N | K | | | i243/94 | | |
| 36 | 36 | K | I | R | | i243/94 | 6613 | |
| 38 | 38 | P | M | | | i243/94 | | |
| 45 | 45 | S | A | | | i243/94 | | |
| 60 | 60 | T | A | | | A5054, B5055, i225/94, D5050, E5051, Aerogenes4140, 1015, Mich61, 2069/49, i243/94, 2005/49, 1754/49, 1702/49, i202/94, 1996/49, 1680/49, 2002/49, 6613, 5725y, 7824, 6258, 6168, i256/94, 7749, 2482, 5281, i224/94, 1756/51, Stanley, 3985/51, i221/94, 4463/52, 5710/52, 5711/52, 5845/52, NCTC8172, 708, 370, 5053 | | |
| 75 | 75 | A | G | | | 5725y | | |
| 79 | 79 | Q | H | | | 5725y | | |
| 92 | 92 | A | P | | | 5725y | | |
| 93 | 93 | W | R | | | 5725y | | |
| 99 | 99 | G | R | | | 5725y | | |
| 112 | 112 | N | T | | | i202/94, 4463/52 | | |
| 119 | 119 | E | G | | | A5054 | | |
| 122 | 122 | G | D | | | D5050, E5051, i243/94, 1756/51, Stanley | | |
| 124 | 124 | Q | E | | | 2482 | | |
| 133 | 133 | S | L | | | 5725y | | |
| 136 | 136 | R | H | S | | i224/94, 3985/51, NCTC8172 | 2069/49 | |
| 151 | 151 | M | A | T | V | i202/94, 4463/52 | i225/94, 2005/49 | A5054, Aerogenes4140, 1015, Mich61, 1754/49, 1702/49, 1996/49, 1680/49, 2002/49, 6613, 7824, 6258, 6168, i256/94, 7749, 2482, i221/94, 5710/52, 5845/52, 708, 370, 5053 |
| 152 | 152 | T | A | | | i225/94, 2005/49 | | |
| 176 | 176 | V | I | | | i202/94, 4463/52 | | |
| 211 | 211 | S | T | | | 5725y | | |
| 229 | 229 | L | M | | | 5725y | | |
| 238 | 238 | P | T | | | 5725y | | |

TABLE 10-continued

Gene conservation of KPORF-32.

| Reference position | Alignment position | Amino acid in Reference | AA change[1] | AA change[2] | AA change[3] | Strains with respective change[1] | Strains with respective change[2] | Strains with respective change[3] |
|---|---|---|---|---|---|---|---|---|
| 240 | 240 | V | G | | | 5725y | | |
| 259 | 259 | P | T | | | 5725y | | |
| 262 | 262 | D | N | | | i243/94, i202/94, 1756/51, Stanley, 4463/52 | | |
| 264 | 264 | D | E | | | i243/94, i202/94, 1756/51, Stanley, 4463/52 | | |
| 265 | 265 | D | E | | | i202/94, 4463/52 | | |
| 268 | 268 | N | Y | | | 5725y | | |
| 272 | 272 | S | G | | | i202/94, 4463/52 | | |
| 276 | 276 | N | H | | | 5725y | | |
| 281 | 281 | N | K | | | 5725y | | |
| 286 | 286 | Q | P | | | 5725y | | |
| 294 | 294 | C | R | | | 5725y | | |
| 312 | 312 | R | P | | | 5725y | | |
| 315 | 315 | Q | L | | | 1754/49 | | |
| 316 | 316 | T | A | | | i202/94, 4463/52 | | |
| 320 | 320 | T | K | | | 5725y | | |
| 354 | 354 | M | T | | | i243/94 | | |
| 359 | 359 | A | G | | | 5725y | | |
| 360 | 360 | P | S | | | i243/94, 1756/51, Stanley | | |
| 363 | 363 | Y | F | S | | 4463/52 | 5725y | |
| 367 | 367 | E | D | | | 6613 | | |
| 368 | 368 | V | L | M | | 2069/49 | 1015, i243/94, 6613, 5053 | |
| 371 | 371 | V | L | | | 5725y | | |
| 374 | 374 | W | R | | | i243/94 | | |
| 377 | 377 | G | R | | | i243/94 | | |
| 379 | 379 | N | K | | | i243/94 | | |
| 380 | 380 | F | T | | | i243/94 | | |
| 382 | 382 | W | S | | | i243/94 | | |
| 383 | 383 | A | P | | | 6613 | | |
| 387 | 387 | A | L | | | i243/94 | | |
| 388 | 388 | W | H | | | i243/94 | | |
| 390 | 390 | C | S | | | i243/94 | | |
| 391 | 391 | A | V | Y | | D5050 | i243/94 | |
| 394 | 394 | L | H | | | i243/94 | | |
| 395 | 395 | V | M | Q | | A5054 | i243/94 | |
| 397 | 397 | G | E | | | Aerogenes4140, 7824 | | |

[1,2,3] observed amino acid at respective position in any of the sequenced genes of the respective *Klebsiella* sp. strains in reference to *Klebsiella pneumoniae* MGH78578.

TABLE 11

Gene conservation of KPORF-37.

| Reference position | Alignment position | Amino acid in Reference | AA change[1] | AA change[2] | Strains with respective change[1] | Strains with respective change[2] |
|---|---|---|---|---|---|---|
| 213 | 213 | I | V | | 2005/49 | |
| 218 | 218 | T | I | | i202/94, 4463/52 | |
| 225 | 225 | H | R | | i202/94, 4463/52 | |
| 254 | 254 | G | E | | D5050, E5051 | |
| 299 | 299 | M | T | | 1193 | |
| 364 | 364 | D | H | T | 1470 | NCTC8172 |
| 509 | 509 | D | G | | 1680/49 | |
| 513 | 513 | E | A | | i202/94, 4463/52 | |
| 523 | 523 | V | I | | i243/94, 1756/51 | |
| 551 | 551 | S | T | | i243/94, i202/94, 1756/51, 4463/52 | |
| 615 | 615 | E | K | | D5050, E5051 | |
| 618 | 618 | R | Q | | 1680/49 | |
| 727 | 727 | E | D | | A5054, B5055, D5050, E5051, 1015, 919, 313, 1470, Mich61, 2069/49, 2005/49, 1754/49, 1996/49, 1680/49, 2002/49, 6613, 5758, 6258, 6168, i256/94, i224/94, i221/94, 5710/52, 5711/52, 370, Friedländer 204, 5053 | |
| 731 | 731 | K | T | | i202/94, 4463/52 | |
| 792 | 792 | C | W | | 1680/49 | |
| 803 | 803 | A | T | | A5054 | |
| 827 | 827 | D | N | | 7749 | |
| 845 | 845 | E | K | | Aerogenes4140 | |

TABLE 11-continued

Gene conservation of KPORF-37.

| Reference position | Alignment position | Amino acid in Reference | AA change[1] | AA change[2] | Strains with respective change[1] | Strains with respective change[2] |
|---|---|---|---|---|---|---|
| 846 | 846 | K | N | | i243/94, 1756/51 | |
| 847 | 847 | A | V | | i243/94, 1756/51 | |

[1,2] observed amino acid at respective position in any of the sequenced genes of the respective *Klebsiella* sp. strains in reference to *Klebsiella pneumoniae* MGH78578.

TABLE 12

Sequence length (in amino acids) as obtained by sequencing of *Klebsiella* gene KPORF-38 from selected *Klebsiella* species and strains. All sequences were determined from the first codon (Start) to the indicated position.

| Strain name | Sequence obtained (aa) | SEQ ID NO |
|---|---|---|
| MGH78578 | 1663 | 580 |
| A5054 | 1254 | 581 |
| i252/94 | 951 | 582 |
| B5055 | 1403 | 583 |
| i225/94 | 1454 | 584 |
| D5050 | 1492 | 585 |
| E5051 | 1463 | 586 |
| Aerogenes4140 | 1492 | 587 |
| 1015 | 1457 | 588 |
| i262/94 | 1489 | 589 |
| 919 | 1476 | 590 |
| 313 | 1490 | 591 |
| 1470 | 1490 | 592 |
| 1193 | 1492 | 593 |
| Mich61 | 1490 | 594 |
| 2069/49 | 1491 | 595 |
| 2005/49 | 1489 | 596 |
| 1702/49 | 1419 | 597 |
| 1996/49 | 1489 | 598 |
| 1680/49 | 1484 | 599 |
| 2002/49 | 1489 | 600 |
| 6613 | 1482 | 601 |
| 5758 | 1240 | 602 |
| 7824 | 1492 | 603 |
| 6258 | 1423 | 604 |
| 6168 | 1491 | 605 |
| i256/94 | 1489 | 606 |
| 7749 | 1492 | 607 |
| 2482 | 1492 | 608 |
| 5281 | 1492 | 609 |
| i224/94 | 1492 | 610 |
| i221/94 | 1487 | 611 |
| 5710/52 | 1489 | 612 |
| 5711/52 | 1490 | 613 |
| NCTC8172 | 1252 | 614 |
| 708 | 949 | 615 |
| Friedländer 204 | 1244 | 616 |
| 5053 | 1474 | 617 |

TABLE 13

Gene conservation of KPORF-39.

| Reference position | Alignment position | Amino acid in Reference | AA change[1] | AA change[2] | Strains with respective change[1] | Strains with respective change[2] |
|---|---|---|---|---|---|---|
| 1 | 1 | V | M | | 264-1 | |
| 2 | 2 | D | E | | 264-1, 265-1, 889 | |
| 45 | 45 | N | S | | 265-1, 889 | |
| 50 | 50 | L | F | | 265-1 | |
| 52 | 52 | P | S | | i256/94 | |
| 58 | 58 | V | L | | 264-1, 265-1, 889 | |
| 82 | 82 | S | N | | 6258, 3985/51 | |
| 96 | 96 | I | L | | 264-1, 265-1, 889 | |
| 117 | 117 | I | L | | 265-1, 889 | |
| 119 | 119 | A | S | | 264-1 | |
| 123 | 123 | A | T | | i252/94, i262/94, i243/94, 1756/51, Stanley, 4463/52 | |
| 126 | 126 | S | T | | 265-1, 889 | |
| 157 | 157 | P | A | | 264-1, 265-1, 889 | |
| 159 | 159 | D | S | | 265-1, 889 | |
| 161 | 161 | T | A | | 264-1 | |
| 176 | 176 | L | V | | 264-1 | |
| 182 | 182 | T | S | | 265-1, 889 | |
| 193 | 193 | S | N | | 265-1, 889 | |
| 199 | 199 | V | S | | 264-1, 265-1, 889 | |
| 201 | 201 | T | A | | 264-1, 265-1, 889 | |
| 213 | 213 | L | M | | 6613, 5758, 5710/52 | |
| 232 | 232 | M | I | | 265-1, 889 | |
| 234 | 234 | A | S | | i262/94, i243/94, 1756/51, Stanley | |
| 236 | 236 | K | A | | 264-1, 265-1, 889 | |
| 237 | 237 | A | P | T | 1756/51 | 1470 |

TABLE 13-continued

Gene conservation of KPORF-39.

| Reference position | Alignment position | Amino acid in Reference | AA change[1] | AA change[2] | Strains with respective change[1] | Strains with respective change[2] |
|---|---|---|---|---|---|---|
| 241 | 241 | N | K | | 264-1, 265-1, 889 | |
| 243 | 243 | N | K | | i202/94, 4463/52 | |
| 245 | 245 | D | E | | 265-1, 889 | |
| 245 | 246 | — | Q | | 889 | |

[1,2]observed amino acid at respective position in any of the sequenced genes of the respective *Klebsiella* sp. strains in reference to *Klebsiella pneumoniae* MGH78578.

TABLE 14

Gene conservation of KPORF-60.

| Reference position | Alignment position | Amino acid in Reference | AA change[1] | AA change[2] | AA change[3] | Strains with respective change[1] | Strains with respective change[2] | Strains with respective change[3] |
|---|---|---|---|---|---|---|---|---|
| 5 | 5 | F | L | | | 265-1, 889 | | |
| 21 | 21 | H | Q | | | 265-1, 889 | | |
| 24 | 24 | N | D | E | T | D5050, 264-1 | 265-1, 889 | Stanley |
| 26 | 26 | T | Q | | | 265-1, 889 | | |
| 28 | 28 | V | I | | | 265-1, 889 | | |
| 66 | 66 | T | A | I | | 265-1, 889 | 6613 | |
| 95 | 95 | D | E | | | 265-1, 889 | | |
| 117 | 117 | N | K | | | 265-1, 889 | | |
| 138 | 138 | S | G | | | D5050, 264-1, 265-1, 889 | | |
| 192 | 192 | N | H | | | 265-1, 889 | | |
| 194 | 194 | K | Q | | | 265-1, 889 | | |
| 200 | 200 | E | D | | | D5050, 264-1, 265-1, 889 | | |
| 206 | 206 | N | S | | | 265-1, 889 | | |
| 231 | 231 | D | E | | | i252/94, D5050, i262/94, i243/94, i202/94, 1996/49, 1756/51, Stanley, 4463/52, 264-1, 265-1, 889 | | |

[1,2,3]observed amino acid at respective position in any of the sequenced genes of the respective *Klebsiella* sp. strains in reference to *Klebsiella pneumoniae* MGH78578.

TABLE 15

Gene conservation of KPORF-65.

| Reference position | Alignment position | Amino acid in Reference | AA change[1] | Strains with respective change[1] |
|---|---|---|---|---|
| 36 | 36 | I | V | i252/94, i262/94, i243/94, 1756/51, Stanley |
| 48 | 48 | D | N | i252/94, i262/94, i243/94, 1756/51, Stanley |
| 61 | 61 | L | P | E5051 |
| 100 | 100 | Q | H | i202/94 |
| 115 | 115 | D | E | i202/94 |
| 125 | 125 | R | P | i202/94 |
| 128 | 128 | R | A | i202/94 |
| 144 | 144 | A | V | i202/94 |
| 186 | 186 | D | H | i202/94 |
| 215 | 215 | E | D | i202/94 |
| 283 | 283 | I | V | i252/94, i262/94, i243/94, 1756/51, Stanley |
| 303 | 303 | S | R | Stanley |
| 308 | 308 | A | G | i252/94, i262/94, i243/94, i202/94, 1756/51, Stanley, 4463/52 |
| 364 | 364 | E | D | i252/94, i262/94, i243/94, 1756/51, Stanley |
| 376 | 376 | G | D | E5051 |
| 389 | 389 | D | G | Friedländer 204 |
| 405 | 405 | S | A | i202/94, 4463/52 |
| 422 | 422 | S | A | i202/94, 4463/52 |
| 471 | 471 | I | L | A5054 |
| 481 | 481 | P | S | 5725y |
| 497 | 497 | V | I | NCTC8172 |
| 511 | 511 | Y | F | 5725y |
| 516 | 516 | K | Q | Aerogenes4140 |
| 520 | 520 | Y | F | i252/94, D5050, i262/94, i243/94, i202/94, 5725y, 1756/51, Stanley, 4463/52 |
| 565 | 565 | S | A | D5050, 5725y |
| 589 | 589 | M | I | D5050, 5725y |
| 619 | 619 | T | N | D5050, 5725y |

[1]observed amino acid at respective position in any of the sequenced genes of the respective *Klebsiella* sp. strains in reference to *Klebsiella pneumoniae* MGH78578.

TABLE 16

Overview over the antigen fragments used for protection experiments (Example 8)

| Fragment name | Seq-ID of fragment DNA/protein | Seq-ID of full length DNA/protein | Location in full length aa from-to |
|---|---|---|---|
| KPORF-02.1 | 1/188 | 18/205 | 2-130 |
| KPORF-13.1 | 2/189 | 29/216 | 26-356 |
| KPORF-20.1 | 3/190 | 36/223 | 2-180 |
| KPORF-21.1 | 4/191 | 37/224 | 1-168 |
| KPORF-32.1 | 375/376 | 48/235 | 23-397 |
| KPORF-37.1 | 5/192 | 53/240 | 2-420 |
| KPORF-37.2 | 6/193 | 53/240 | 414-847 |

TABLE 16-continued

Overview over the antigen fragments used for
protection experiments (Example 8)

| Fragment name | Seq-ID of fragment DNA/protein | Seq-ID of full length DNA/protein | Location in full length aa from-to |
|---|---|---|---|
| KPORF-38.2 | 7/194 | 54/241 | 582-1099 |
| KPORF-39.1 | 8/195 | 55/242 | 1-245 |
| KPORF-44.1 | 9/196 | 60/247 | 24-703 |
| KPORF-49.1 | 10/197 | 65/252 | 23-328 |
| KPORF-60.1 | 11/198 | 76/263 | 23-248 |
| KPORF-64.1 | 12/199 | 80/267 | 2-335 |
| KPORF-65.1 | 13/200 | 81/268 | 38-633 |
| KPORF-66.1 | 14/201 | 82/269 | 26-742 |
| KPORF-78.1 | 15/202 | 94/281 | 26-429 |
| KPORF-82.1 | 16/203 | 98/285 | 1-632 |

EXAMPLES

Example 1

General Screening Procedure for the Identification of the Peptides According to the Present Invention The approach, which has been employed for the present invention, is based on the interaction of proteins or peptides encoded by K. pneumoniae with the antibodies present in human sera. The antibodies produced against K. pneumoniae by the human immune system and present in human sera are indicative of the in vivo expression of the antigenic proteins and their immunogenicity. In addition, the antigenic proteins as identified by the bacterial surface display expression libraries using pools of pre-selected sera, are processed in a second and third round of screening by individual selected or generated sera. Thus the present invention supplies an efficient, relevant, comprehensive set of antigens as a pharmaceutical composition, especially a vaccine preventing infections caused by K. pneumoniae.

In the antigen identification program for identifying a comprehensive set of antigens according to the present invention, at least two different bacterial surface expression libraries from K. pneumoniae are screened with several serum pools or plasma fractions (antibody pools). The antibody pools are derived from a serum collection, which has been tested against antigenic compounds of K. pneumoniae, such as whole cell, total extracts. Preferably, four pools of sera (with 17 individual samples) are used. Sera determined to have high ELISA titre have to react with multiple proteins in immunoblotting in order to be considered hyperimmune and therefore relevant in the screening method applied for the present invention.

The expression libraries as used in the present invention should allow expression of all potential antigens, e.g. derived from all secreted and surface proteins of K. pneumoniae. Bacterial surface display libraries will be represented by a recombinant library of a bacterial host displaying a (total) set of expressed peptide sequences of K. pneumoniae on two selected outer membrane proteins (LamB and FhuA) at the bacterial host membrane (Georgiou, G., 1997); (Etz, H. et al., 2001). One of the advantages of using recombinant expression libraries is that the identified antigens may be instantly produced by expression of the coding sequences of the screened and selected clones expressing the antigens without further recombinant DNA technology or cloning steps necessary.

The comprehensive set of antigens identified by the described program according to the present invention is analyzed further by one or more additional rounds of screening. Therefore individual antibody preparations or antibodies generated against selected peptides, which were identified as immunogenic are used. According to a preferred embodiment the individual antibody preparations for the second round of screening are derived from healthy adults and/or challenged adults who show an antibody titre above a certain minimum level, for example an antibody titre being higher than 80 percentile, preferably higher than 90 percentile, especially higher than 95 percentile of the human (patient or healthy individual) sera tested. Using such high titre individual antibody preparations in the second screening round allows a very selective identification of the antigens and fragments thereof from K. pneumoniae.

Following the comprehensive screening procedure, the selected antigenic proteins, expressed as recombinant proteins or in vitro translated products, in case it can not be expressed in prokaryotic expression systems, or the identified antigenic peptides (produced synthetically) are tested in a second screening by a series of ELISA and Western blotting assays for the assessment of their immunogenicity with a large human serum collection (minimum ~20 healthy and patients sera).

It is important that the individual antibody preparations (which may also be the selected serum) allow a selective identification of the most promising candidates of all the antigens from all the promising candidates from the first round. Therefore, preferably at least 10 individual antibody preparations (i.e. antibody preparations (e.g. sera) from at least 10 different individuals exposed to the chosen pathogen) should be used in identifying these antigens in the second screening round. Of course, it is possible to use also less than 10 individual preparations, however, selectivity of the step may not be optimal with a low number of individual antibody preparations. On the other hand, if a given antigen (or an antigenic fragment thereof) is recognized by at least 10 individual antibody preparations, preferably at least 30, especially at least 50 individual antibody preparations, identification of the antigen is also selective enough for a proper identification. Serum-reactivity may of course be tested with as many individual preparations as possible (e.g. with more than 100 or even with more than 1,000).

Therefore, the relevant portion of the serum-reactive antibody preparations according to the method of the present invention should preferably be at least 10, more preferably at least 30, especially at least 50 individual antibody preparations. Alternatively (or in combination) antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titre against K. pneumoniae (e.g. against a preparation of this pathogen, such as a lysate, cell wall components and recombinant proteins). Preferably, some are selected with an IgG titre above 1,000 U, especially above 5,000 U (U=units, calculated from the $OD_{405nm}$ reading at a given dilution) when the whole organism (total lysate or whole cells) is used as antigen in the ELISA.

The antibodies produced against K. pneumoniae by the human immune system and present in human sera are indicative of the in vivo expression of the antigenic proteins and their immunogenicity. The recognition of linear epitopes recognized by serum antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens are located on the cell surface or secreted, and are therefore accessible extracellularly. Antibodies against cell wall proteins are expected to serve multiple purposes: to inhibit adhesion, to interfere with nutrient acquisition, to inhibit immune evasion and to promote phagocytosis (Hornef, M. et al., 2002). Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within infection causing pathogen species. Bioinformatic analyses (signal sequences, cell wall localisation signals, transmembrane domains) proved to be very useful in assessing cell surface localisation or secretion. The experimental approach includes the isolation of antibodies with the corresponding epitopes and proteins from human serum, and the generation of immune sera in mice against (poly) peptides selected by the bacterial surface display screens. These sera are then used in a third round of screening as reagents in at least one of the following assays: cell surface staining of K. pneumoniae grown under different conditions (FACS or microscopy), determination of neutralizing capacity (toxin, adherence), and promotion of opsonization and phagocytosis (in vitro phagocytosis assay).

For that purpose, bacterial E. coli clones are directly injected into mice and immune sera are taken and tested in the relevant in vitro assay. Alternatively, specific antibodies may be purified from human or mouse sera using peptides or proteins as substrate.

According to the antigen identification method used herein, the present invention can surprisingly provide a set of comprehensive novel nucleic acids and novel antigens, variants and fragments thereof of K. pneumoniae, among other things, as described herein. The nucleotide sequences according to the present invention encoding antigens preferably have a nucleotide sequence which is individually set forth in Seq ID Nos 1 to 187 and Seq ID No 375, whereby the corresponding encoded amino acid sequences preferably have an amino acid sequence as set forth in Seq ID Nos 188 to 374 and Seq ID No 376.

All linear fragments of a particular antigen may be identified by analysing the entire sequence of the protein antigen by a set of peptides overlapping by 1 amino acid with a length of at least 10 amino acids. Subsequently, non-linear epitopes can be identified by analysis of the protein antigen with hyperimmune sera using the expressed full-length protein or domain polypeptides thereof. Assuming that a distinct domain of a protein is sufficient to form the 3D structure independent from the native protein, the analysis of the respective recombinant or synthetically produced domain polypeptide with hyperimmune serum would allow the identification of conformational epitopes within the individual domains of multidomain proteins. For those antigens where a domain possesses linear as well as conformational epitopes, competition experiments with peptides corresponding to the linear epitopes may be used to confirm the presence of conformational epitopes.

Example 2

Characterization and Selection of Human Serum Samples Based on Anti-*Klebsiella* Antibodies and Preparation of Antibody Screening Reagents Experimental Procedures Enzyme linked immunosorbent assay (ELISA). ELISA plates (Maxisorb, Millipore) were coated with 5-10 µg/ml total protein diluted in coating buffer (0.1 M sodium carbonate pH 9.2). Two dilutions of sera (1,000× and 5,000×) were made in PBS-BSA. Highly specific Horse Radish Peroxidase (HRP)-conjugated anti-human IgG secondary antibodies (Southern Biotech) were used according to the manufacturer's recommendations (dilution: 1,000×). Antigen-antibody complexes were quantified by measuring the conversion of the substrate (ABTS) to coloured product based on $OD_{405nm}$ readings by automatic ELISA reader (TECAN SUNRISE).

Preparation of total bacterial extracts. The K. pneumoniae strains Mich 61 (K-type 15; O-type 4) and 708 (K-type 80; O-type 12) and their capsule negative variants were grown overnight in Nutrient Broth (Difco 234000) at 37° C. Cells were lysed by repeated freeze-thaw cycles, following incubation on dry ice/ethanol-mixture until frozen for 1 min and thawing at 37° C. for 5 min. The lyses procedure was repeated 3 times, followed by sonication. After centrifugation at 4,000 rpm for 15 min at 4° C., the supernatant contains whole cell extracts and was collected. Pellets were discarded and protein concentration was measured with the Bradford assay using protein assay dye reagent concentrate (Bio-Rad Laboratories, Austria).

Purification of antibodies for genomic screening. Four to five sera per antibody pool were selected mainly based on their stronger reaction in ELISA against the capsule negative strain against the ones with capsule. Antibodies against E. coli DH5alpha proteins were removed by incubating the heat-inactivated sera with whole cell E. coli DH5alpha cells (transformed with pHIE11, grown under the same condition as used for bacterial surface display). Highly enriched preparations of IgGs from the pooled, depleted sera were generated by protein G affinity chromatography, according to the manufacturer's instructions (UltraLink Immobilized Protein G, Pierce). The efficiency of depletion and purification was checked by ELISA measurements.

Results

The antibodies produced against K. pneumoniae by the human immune system and present in human sera are indicative of the in vivo expression of the antigenic proteins and of their immunogenicity. These molecules are essential for the identification of individual antigens in the approach as described in the present invention, which is based on the interaction of the specific anti-bacterial antibodies and the corresponding K. pneumoniae peptides or proteins. To gain access to relevant antibody repertoires, human sera were collected from patients with septicaemia and healthy exposed people. 50 acute phase serum samples and 100 convalescent serum samples were collected from 100 donors and characterized for anti-K. pneumoniae antibodies together with 49 sera taken from healthy individuals by a series of immune assays. Primary characterization was done by ELISA using total bacterial lysates for K. pneumoniae strains Mich 61 and 708 and their respective capsule negative mutants. Antibody titers were measured and ELISA units calculated from serum dilutions in the linear range of response. Sera were ranked based on the differential reaction in ELISA against lysates prepared from strains with and without capsule, which was used for the selection of sera to be included in antibody-pools.

The reactivity of the sera used for the generation of pools against bacterial lysates from *K. pneumoniae* is shown in FIGS. 1A and B.

Selected sera were included in 4 different IgG pools (4-5 sera in each pool) for antigen identification by bacterial surface display. IgG antibodies were purified from pooled sera by affinity chromatography and depleted of *E. coli* DH5alpha-reactive antibodies to avoid background in the bacterial surface display screens. The serum pools representing healthy individuals are ICKp18 (IC38, IC40, IC76 and IC86) and ICKp19 (IC88, IC89, IC92 and IC93) and from patients with septicaemia are PKp34 (P3536.2, P3548, P3560, P3582 and P3583) and PKp35 (P3495.2, P3533.2, P3567 and P3576).

Example 3

Generation of Highly Random, Frame-Selected, Small-Fragment, Genomic DNA Libraries of *K. pneumoniae*

Experimental Procedures

Preparation of genomic DNA from *K. pneumoniae* strain MGH78578 (ATCC 700721). Cells from a 400 ml bacterial culture were harvested (5,000 rpm, 20 min, room temperature), washed with 80 ml 50 mM Tris pH 7.4 and re-suspended in 10 ml 50 mM Tris pH 7.4/25% Sucrose/50 mM EDTA. The suspension was transferred to a fresh glass tube and Lysozyme (final concentration: 1.5 mg/ml) and SDS (final conc.: 2%) were added. The tube was incubated on ice for cell lysis. Proteinase K (final concentration: 0.1 mg/ml) was added and incubated for 10 min at 37° C., followed by Phenol/Chloroform (1:1) extraction, which was performed several times. A final extraction step was performed with Chloroform/Isoamylalcohol (1:24) to remove Phenol traces. The sample was treated with RNase A (final concentration: 10 µg/ml) for 1 h at room temperature and Phenol/Chloroform and Chloroform/Isoamylalcohol extractions were performed as described above. DNA in the remaining supernatant was precipitated by addition of ⅒th of the starting volume of 3 M NaAc (pH 5.3) and 2.5× of the volume of 99.5% Ethanol. After 1 h incubation at −20° C., the mixture was centrifuged (20,000 rpm, 15 min) and the pellet washed with 70% Ethanol. Finally, the pellet was dissolved in TE-buffer.

Preparation of Small Genomic DNA Fragments. Genomic DNA Fragments were Mechanically sheared into fragments ranging in size between 150 and 300 by using a cup-horn sonicator (Bandelin Sonoplus UV 2200 sonicator equipped with a BB5 cup horn, 10 sec. pulses at 100% power output) or into fragments of size between 50 and 70 by mild DNase I treatment (Novagen). It was observed that sonication yielded a much tighter fragment size distribution when breaking the DNA into fragments of the 150-300 by size range. However, despite extensive exposure of the DNA to ultrasonic wave-induced hydromechanical shearing force, subsequent decrease in fragment size could not be efficiently and reproducibly achieved. Therefore, fragments of 50 to 70 by in size were obtained by mild DNase I treatment using Novagen's shotgun cleavage kit. A 1:20 dilution of DNase I provided with the kit was prepared and the digestion was performed in the presence of MnCl$_2$ in a 60 µl volume at 20° C. for 5 min to ensure double-stranded cleavage by the enzyme. Reactions were stopped with 2 µl of 0.5 M EDTA and the fragmentation efficiency was evaluated on a 2% TAE-agarose gel. This treatment resulted in total fragmentation of genomic DNA into near 50-70 by fragments. Fragments were then blunt-ended twice using T4 DNA Polymerase in the presence of 100 µM each of dNTPs to ensure efficient flushing of the ends. Fragments were used immediately in ligation reactions or frozen at −20° C. for subsequent use.

Description of the vectors. The vector pMAL4.31 was constructed on a pASK-IBA backbone (Skerra, A., 1994) with the beta-lactamase (bla) gene exchanged with the Kanamycin resistance gene. In addition, the bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane (Kajava, A. et al., 2000). A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that the bla gene is transcribed in the −1 reading frame resulting in a stop codon 15 by after the NotI site. A +1 by insertion restores the bla ORF so that beta-lactamase protein is produced with a consequent gain of Ampicillin resistance.

The vector pMAL9.1 was constructed by cloning the lamB gene into the multiple cloning site of pEH1 (Hashemzadeh-Bonehi, L. et al., 1998). Subsequently, a sequence was inserted in lamB after amino acid 154, containing the restriction sites FseI, SmaI and NotI. The reading frame for this insertion was constructed in such a way that transfer of frame-selected DNA fragments excised by digestion with FseI and NotI from plasmid pMAL4.31 yields a continuous reading frame of lamB and the respective insert.

The vector pHIE11 was constructed by cloning the JhuA gene into the multiple cloning site of pEH1. Thereafter, a sequence was inserted in fhuA after amino acid 405, containing the restriction site FseI, XbaI and NotI. The reading frame for this insertion was chosen in a way that transfer of frame-selected DNA fragments excised by digestion with FseI and NotI from plasmid pMAL4.31 yields a continuous reading frame of fhuA and the respective insert.

Cloning and evaluation of the library for frame selection. Genomic *K. pneumoniae* (strain MGH78578). DNA fragments were ligated into the SmaI site of the vector pMAL4.31. Recombinant DNA was electroporated into DH10B electrocompetent *E. coli* cells (GIBCO BRL) and transformants plated on LB-agar supplemented with Kanamycin (50 µg/ml) and Ampicillin (50 µg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Figure 2A:
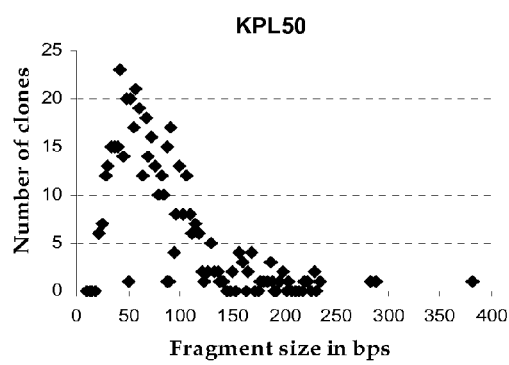
FIG. 2 shows the characterization of the libraries.
Figure 2B:
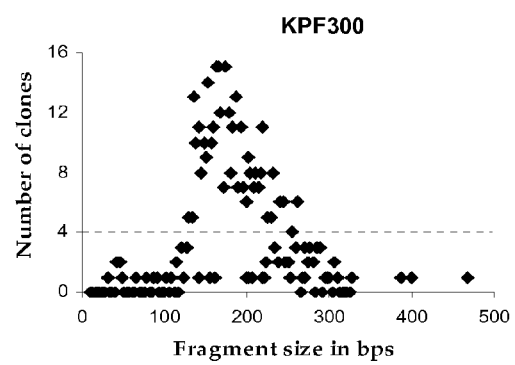

Cloning and evaluation of the library for bacterial surface display. Genomic DNA fragments were excised from the pMAL4.31 vector, containing the *K. pneumoniae* library with the restriction enzymes FseI and NotI. The entire population of fragments was then transferred into plasmids pMAL9.1 (LamB) or pHIE11 (FhuA), which have been digested with FseI and NotI. Using these two restriction enzymes, which recognise an 8 by GC rich sequence, the reading frame that was selected in the pMAL4.31 vector is maintained in each of the platform vectors. The plasmid library was then transformed into E. coli DH5alpha cells by electroporation. Cells were plated onto large LB-agar plates supplemented with 50 μg/ml Kanamycin and grown over night at 37° C. at a density yielding clearly visible single colonies. Cells were then scraped off the surface of these plates, washed with fresh LB medium and stored in aliquots for library screening at −80° C.
Results Libraries for frame selection. Two libraries were generated for K. pneumoniae strain MGH78578 in the pMAL4.31 vector with sizes of approximately 70 and 300 bp, respectively. For each library, ligation and subsequent transformation of approximately 1 μg of pMAL4.31 plasmid DNA and 50 ng of fragmented genomic K. pneumoniae DNA yielded $3 \times 10^5$ to $2 \times 10^6$ clones after frame selection. To assess the randomness of the libraries, approximately 500 to 600 randomly chosen clones of each library were sequenced. The representative bioinformatic analysis of two libraries (KPL50 and KPF300) showed that of clones corresponding to these libraries only very few were present more than once. Furthermore, it was shown for the KPL50 library that the average insert size was 77 bp, very close to the expected insert size (FIG. 2A). Regarding the KPF300 library, the average insert size was 187 by slightly shorter than the expected insert size (FIG. 2B).

Bacterial surface display libraries. The display of peptides on the surface of E. coli required the transfer of the inserts from the KPL50 and the KPF300 libraries from the frame selection vector pMAL4.31 to the display plasmids pMAL9.1 (LamB) or pHIE11 (FhuA). Genomic DNA fragments were excised by FseI and NotI restriction and ligation of 5 ng inserts with 0.1 μg plasmid DNA and subsequent transformation into DH5alpha cells resulted in $3 \times 10^5$ to $2 \times 10^6$ clones. The clones were scraped off the LB plates and frozen without further amplification.

Example 4

Identification of Highly Immunogenic Peptide Sequences from K. pneumoniae Using Bacterial Surface Displayed Genomic Libraries and Human Serum Experimental Procedures MACS screening. Approximately $2.5 \times 10^8$ cells from a given library were grown in 5 ml LB-medium supplemented with 50 μg/ml Kanamycin for 2 h at 37° C. Expression was induced by the addition of 1 mM IPTG for 30 min. Cells were washed twice with fresh LB medium and approximately $2 \times 10^7$ cells re-suspended in 100 μl LB medium and transferred to an Eppendorf tube.

10 to 20 μg of biotinylated, human IgGs purified from serum was added to the cells and the suspension incubated overnight at 4° C. with gentle shaking 900 μl of LB medium was added, the suspension mixed and subsequently centrifuged for 10 min at 6,000 rpm at 4° C. Cells were washed once with 1 ml LB and then re-suspended in 100 μl LB medium. 10 μl of MACS microbeads coupled to streptavidin (Miltenyi Biotech, Germany) were added and the incubation continued for 20 min at 4° C. Thereafter 900 μl of LB medium was added and the MACS microbead cell suspension was loaded onto the equilibrated MS column (Miltenyi Biotech, Germany), which was fixed to the magnet. The MS columns were equilibrated by washing once with 1 ml 70% EtOH and twice with 2 ml LB medium.

The column was then washed three times with 3 ml LB medium. After removal of the magnet, cells were eluted by washing with 2 ml LB medium. After washing the column with 3 ml LB medium, the 2 ml eluate was loaded a second time on the same column and the washing and elution process repeated. The loading, washing and elution process was performed a third time, resulting in a final eluate of 2 ml.

Cells selected after two rounds of selection were plated onto LB-agar plates supplemented with 50 μg/ml Kanamycin and grown over night at 37° C.

Evaluation of selected clones by sequencing and Western blot analysis. Randomly selected clones were grown overnight at 37° C. in 3 ml LB medium supplemented with 50 μg/ml Kanamycin to prepare plasmid DNA using standard procedures. Sequencing was performed at MWG (Germany) or Agowa (Germany).

Figure 3A:
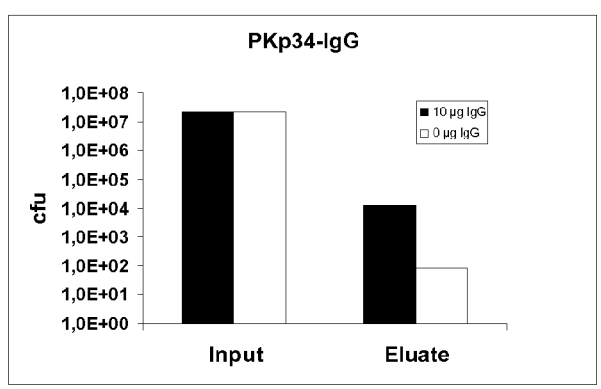
FIG. 3 shows the selection of bacterial cells by MACS using biotinylated human IgGs.
Figure 3B:
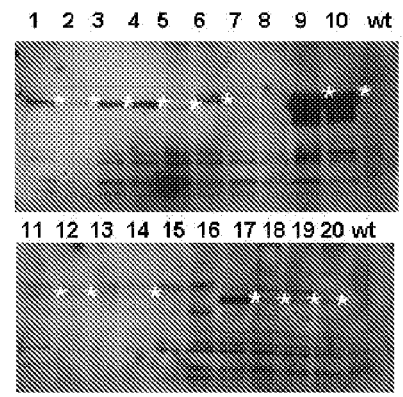
Figure 3C:
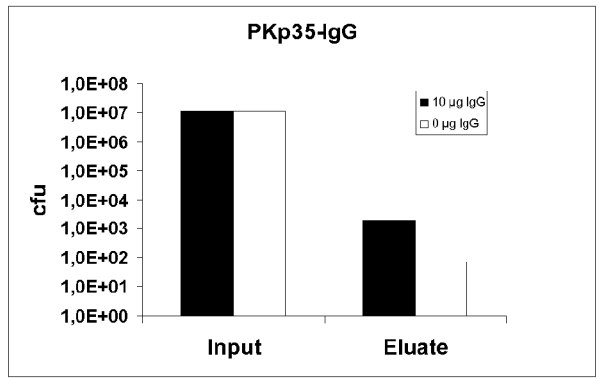
Figure 3D:
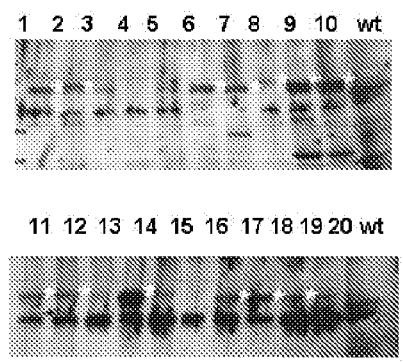

For Western blot analysis approximately 10 to 20 μg of total cellular protein was separated by 10% SDS-PAGE and blotted onto HybondC membrane (Amersham Pharmacia Biotech, England). The LamB or FhuA fusion proteins were detected using human serum as the primary antibody at a dilution of approximately 1:3,000 to 1:5,000 and anti-human IgG antibodies coupled to HRP at a dilution of 1:5,000 as secondary antibodies. Detection was performed using the ECL detection kit (Amersham Pharmacia Biotech, England). Alternatively, rabbit anti-FhuA or rabbit anti-LamB polyclonal immune sera were used as primary antibodies in combination with the respective secondary antibodies coupled to HRP for the detection of the fusion proteins.
Results Screening of bacterial surface display libraries by magnetic activated cell sorting (MACS) using biotinylated Igs. The libraries KPL50 in pMAL9.1 and KPF300 in pHIE11 were screened with pools of biotinylated, human IgGs prepared from sera of uninfected healthy adults (IC38, IC40, IC76, IC86, IC88, IC89, IC92, and IC93) and patients with acute K. pneumoniae infections (septicaemia) (P3536.2, P3548, P3560, P3582, P3583, P3495.2, P3533.2, P3567 and P3576) (see Example 1: Preparation of Antibodies from Human Serum). The selection procedure was performed as described under Experimental procedures. FIG. 3A shows a representative example of a screen with the KPL50 library and PKp34-IgGs. As can be seen from the colony count after the first selection cycle from MACS screening, the total number of cells recovered at the end is drastically reduced from $2.2 \times 10^7$ cells to approximately $1.2 \times 10^4$ cells, and the selection without antibodies showed a more pronounced reduction in cell numbers, showing that selection was dependent on K. pneumoniae specific antibodies (FIG. 3A). To evaluate the performance of the screen, 20 selected clones were picked randomly and subjected to immunoblot analysis with the screening PKp34-IgG pool (FIG. 3B). This analysis revealed that a majority of selected clones showed reactivity with antibodies present in the relevant serum whereas the control strain expressing FhuA without a K. pneumoniae specific insert did not react with the same serum. In general, the rate of reactivity was observed to lie within the range of 15 to 85%. Colony PCR analysis showed that all selected clones contained an insert in the expected size range (data not shown). Similar results were seen in screens with libraries from the other serum pools. As a second example, FIGS. 3C and D show the data obtained with the large insert KPF300 and the PKp35-IgG antibody pool. One round of MACS selection resulted in the enrichment of cells only in the presence, but not the absence of specific IgG (FIG. 3C), indicating that the selection was specific for the applied antibodies. The specific selection was then confirmed in the Western blot analysis of individual bacterial clones with the same PKp35-IgG antibody pool (FIG. 3D).

Subsequent sequencing of a larger number of randomly picked clones (600 to 800) from each screen led to the identification of the gene and the corresponding peptide or protein sequence that was specifically recognized by the human serum antibodies used for screening. The frequency with which a specific clone is selected reflects at least in part the abundance and/or affinity of the specific antibodies in the serum used for selection and recognizing the epitope presented by this clone. Table 1 summarizes the data obtained for all 8 performed screens. All clones that are presented in Table 1 have been verified by immunoblot analysis using whole cellular extracts from single clones to show the indicated reactivity with the pool of human serum used in the respective screen. As can be seen from Table 1, distinct regions of the identified ORF are identified as immunogenic, since variably sized fragments of the proteins are displayed on the surface by the platform proteins.

It is further worth noticing that many of the genes identified by the bacterial surface display screens encode proteins that are attached to the surface of the bacterium. This is in accordance with the expected role of surface attached proteins in virulence of *K. pneumoniae*.

Example 5

Gene Distribution Studies with Highly Immunogenic Proteins Identified from *K. pneumoniae*

Experimental Procedures

Gene distribution of antigens by PCR. An ideal vaccine antigen would be an antigen that is present in all, or the vast majority of strains of the target organism the vaccine is directed to. In order to establish whether the genes encoding the identified *K. pneumoniae* antigens occur ubiquitously in the relevant strains, PCR was performed on a series of independent bacterial isolates with primers specific for the gene of interest. Oligonucleotide sequences as primers were designed for all identified ORFs yielding products of approximately 1,000 bp, if possible covering all identified immunogenic epitopes. Genomic DNA of all *K. pneumoniae* strains was prepared as described under Example 2. PCR was performed in a reaction volume of 25 µA using Taq polymerase (1 U), 200 nM dNTPs, 10 pMol of each oligonucleotide and the kit according to the manufacturer's instructions (Invitrogen, The Netherlands). As standard, 30 cycles (lx: 5 min. 95° C., 30×: 30 sec. 95° C., 30 sec. 56° C., 30 sec. 72° C., 1×4 min. 72° C.) were performed, unless conditions had to be adapted for individual primer pairs.

Results

Identified genes encoding immunogenic proteins were tested by PCR for their presence in 46 different *K. pneumoniae* strains (Table 3). All together 95 genes were analyzed. 40% (38/95) were detected in >90% of strains (>41/46), while 25% (24/95) were missing in >75% of the strains (<35/46) and therefore categorized as not sufficiently conserved. As an example, FIG. 4 shows the PCR reaction for the *K. pneumoniae* KPORF-54 antigen with all indicated 46 strains. As clearly visible, the gene is present in all strains analyzed. All results with the selected antigens are summarized in Table 3. Importantly, 80% of the identified antigens were well conserved among the strains of *Klebsiella pneumoniae* analyzed, at least in the presence and size of the gene-specific PCR products, therefore selected for further studies to evaluate their vaccine candidate potential.

Example 6

Validation of Peptides from *K. pneumoniae* by Peptide ELISA

Enzyme linked immunosorbent assay (ELISA). ELISA plates (Maxisorb, Millipore) were coated with 5-10 µg/ml total protein diluted in coating buffer (0.1 M sodium carbonate pH 9.2). Two dilutions of sera (400× and 2,000×) were made in PBS-BSA. Highly specific Horse Radish Peroxidase (HRP)-conjugated anti-human IgG secondary antibodies (Southern Biotech) were used according to the manufacturer's recommendations (dilution: 1,000×). Antigen-antibody complexes were quantified by measuring the conversion of the substrate (ABTS) to coloured product based on $OD_{405nm}$ readings by automatic ELISA reader (TECAN SUNRISE). The measurements at 400× dilution were used for the calculation of the results as displayed in Table 4.

Results

Immunogenicity in humans. The presence of specific antibodies in human sera was determined by peptide ELISA as summarized in Table 4. The human sera used for this analysis correspond to those that were included in the various serum pools applied for the identification of antigens by the bacterial surface display screens. Single or multiple peptides from individual antigens from *K. pneumoniae* MGH78578 were analyzed and many of these were shown to be immunogenic in humans. It is evident that some of the selected peptides are highly reactive with many or all of the investigated human sera (e.g. ORF-26.01 or ORF-81.01), while others showed intermediate or low reactivities. For those antigens for which the selected epitope encompassed more than 30 amino acids, multiple peptides were designed with an overlap of 5 to 6 amino acids. For some of the antigens, it was observed that these multiple peptides from the same antigen showed different reactivities, further delineating the immunogenic region of the respective antigen (e.g. KPORF-27 or KPORF-42). These experiments confirmed that many of the identified epitopes/proteins are highly immunogenic in humans, indicating that they are expressed by the pathogen during infection and capable of inducing a strong immune response.

Example 7

Surface Binding to *K. pneumoniae* of Immune Sera Obtained from Mice Immunized with Highly Immunogenic Proteins/Peptides from *K. pneumoniae* Displayed on the Surface of *E. coli*

Experimental procedures. FACS analysis. The *K. pneumoniae* strains A5054 and Friedländer 204 were inoculated from a glycerol stock into 5 ml THB medium and incubated over night at 37° C. The overnight culture was reinoculated by adding 200 µA into 10 ml fresh THB medium and incubated until an $OD_{600}$ of approximately 0.6 was reached (~5×10⁸ cells/ml). The bacteria were pelleted by centrifugation at 4,000 rpm for 5 min and washed twice with 2 ml HBSS. The final pellet was resuspended in HBSS with 0.5% BSA to give a cell density of 5×10⁶ cells/ml. To 100 µA bacteria, 5 µA immune serum was added and incubated for 45 min on ice. Bacteria were pelleted by centrifugation at 1,000 g for 4 min and washed once with 1 ml HBSS with 0.5% BSA and resuspended in 100 µA HBSS with 0.5% BSA. To the opsonised bacteria conjugated anti-mouse antibody were added at a dilution according to the manufacturer's recommendations (diluted in 100 µl). Secondary staining was performed on ice for 45 min in darkness. At the end of the incubation, the samples are centrifuged at 5,000 rpm for 3 min, washed with 1 ml HBSS and resuspended in 1 ml of HBSS-2% paraformaldehyde. Samples were vortexed, fixed overnight and analyzed by flow cytometry.

Results

Surface binding to *K. pneumoniae* cells. The presence of antibodies recognising surface proteins on *K. pneumoniae* A5054 and Friedländer 204 were tested in FACS analysis. Of 103 antigens represented by different sera, 36 showed a significant shift in the FACS analysis compared to the buffer control as summarized in Table 5. These in vitro experiments indicate that in in vitro cultured *K. pneumoniae* cells these 36 antigens were expressed on the surface. As an example, FIG. 5 shows the FACS staining for the *K. pneumoniae* KPORF-28, KPORF-82 and KPORF-02 antigens which are representatives of the categories "+", "++" and "+++", respectively.

Example 8

Antigens Induce Protective Immune Responses Against Lethal Sepsis Induced by *K. pneumoniae*

Experimental Procedures

Expression and purification of recombinant *Klebsiella pneumoniae* proteins. Cloning of genes/DNA fragments: The gene/DNA fragment of interest was amplified from genomic DNA of *K. pneumoniae* MGH78578 by PCR using gene specific primers. Apart from the gene specific part, the primers had restriction sites that aided in a directional cloning of the amplified PCR product. The gene annealing (specific) part of the primer ranged between 15-30 bases in length. The PCR products obtained were digested with the appropriate restriction enzymes and cloned into the pET28b (+) vector (Novagen) for His-tagged proteins. Once the recombinant plasmid was confirmed to contain the gene of interest, *E. coli* BL21-CodonPlus® cells (Stratagene) that served as expression host were transformed. The inserts were sequenced. The nucleotide sequences and the amino acid sequences of the gene specific fragments are listed under the respective sequence identification numbers (Seq ID Nos DNA, protein): KPORF-02.1:1, 188; KPORF-13.1:2, 189; KPORF-20.1:3, 190; KPORF-21.1:4, 191; KPORF-32.1:375, 376; KPORF-37.1:5, 192; KPORF-37.2:6, 193; KPORF-38.2:7, 194; KPORF-39.1:8, 195; KPORF-44.1:9, 196; KPORF-49.1:10, 197; KPORF-60.1:11, 198; KPORF-64.1:12, 199; KPORF-65.1:13, 200; KPORF-66.1:14, 201; KPORF-78.1:15, 202; KPORF-82.1:16, 203 (see also Table 16). Expression and purification of proteins. *E. coli* BL21-CodonPlus® cells harboring the recombinant plasmid of choice were grown into log phase in the required culture volume. Once an $OD_{600nm}$ of 0.6 was reached the culture was induced with 0.5 mM IPTG for 3 hours at 37° C. The cells were harvested by centrifugation, lysed by a combination of the freeze-thaw method followed by disruption of cells with 'Bug-buster®, (Novagen). The lysate was separated by centrifugation into soluble (supernatant) and insoluble (pellet) fractions. Depending on the location of the protein different purification strategies were applied. A) If the His-tagged protein was in the soluble fraction, protein purification was done by binding the supernatant to Ni-Sepharose beads (Ni-Sepharose™ 6 Fast Flow, GE Healthcare). Due to the presence of the hexa Histidine (6×HIS) at the C-terminus of the expressed protein, it bound to the Ni-Sepharose while the other contaminating proteins were washed from the column by wash buffer. The protein was eluted by 500 mM Imidazole in 20 mM $NaH_2PO_4$, 0.5 mM NaCl buffer at pH 7.4. The eluate was concentrated, assayed by Bradford for protein concentration and checked by SDS-PAGE and Western blot. B) If the protein was present in the insoluble fraction, the pellet was solubilized in suitable buffer containing 8 M Urea and applied onto the Ni-NTA column under denaturing conditions (in buffer containing 8 M Urea) using the same materials and procedure as mentioned above. Contaminating proteins were washed from the column by wash buffer without urea. Refolding of the His-tagged protein was performed while the protein was immobilized on the Ni-NTA matrix. After renaturation, proteins were eluted by the addition of 500 mM Imidazole. The eluate was dialyzed to remove traces of urea and concentrated if the volume was large, checked by SDS-PAGE and measured by the Bradford method.

Animal Protection Studies

Animals: CD-1 female mice (6-8 weeks) were used.

Active immunization (subcutaneous route): 50 µg of recombinant proteins as listed in Table 16 adjuvanted with either Complete Freund's adjuvant (CFA), Alum, or IC31® were injected subcutaneously into CD-1 mice. On days 14 and 28, mice were boosted with the same amount of protein and adjuvant (except that Incomplete Freund's adjuvant (IFA) was used rather than CFA). Mice immunized with *K. pneumoniae* B5055 lysate served as a positive control, while mice immunized with PBS combined with adjuvant only served as a negative control. Antibody titres were measured at day 35 by ELISA using the respective recombinant proteins.

Passive immunization (intraperitoneal route): 150 µA of hyper-immune rabbit serum raised against individual *K. pneumoniae* recombinant protein antigens as listed in Table 16 was injected intraperitoneally (IP) into CD-1 mice, one to three hours prior to IP bacterial challenge. Antibody titres of the sera used for immunization were measured using the respective recombinant proteins.

Bacterial challenge: Freshly grown *K. pneumoniae* strain B5055 was used. In order to determine the viable cell numbers present in the bacterial inoculum, CFU were determined by plating dilutions of the inoculum onto blood agar plates. $10^3$ CFU were applied intraperitoneally. Protection conferred by immunization was measured using a bacteraemia/sepsis model in which survival rates were followed for 2 weeks post-challenge, and survival was expressed as a percentage of the total number of animals (10 mice/group).

Results

Active Immunization Experiments

As one of the main target indications for a preventive vaccine in humans is sepsis, an intraperitoneal challenge model for the evaluation of candidate antigens was employed and pre-selected *K. pneumoniae* antigens were tested for showing protection in this murine sepsis/lethality model. Protection has so far been observed for two distinct proteins in the intraperitoneal challenge model. As protection against *K. pneumoniae* challenge is mediated by antibodies, immunizations were performed using CFA/IFA as adjuvant in order to obtain the highest levels of antibodies. As can be seen in two independent experiments depicted on FIG. 6A and FIG. 6B/C, proteins KPORF-21.1 and KPORF-60.1 gave 100%, KPORF-38.2 and KPORF-39.1 90% and 60% protection, respectively. These antigens have not previously been shown to protect against *K. pneumoniae* infection.

Figure 6A:
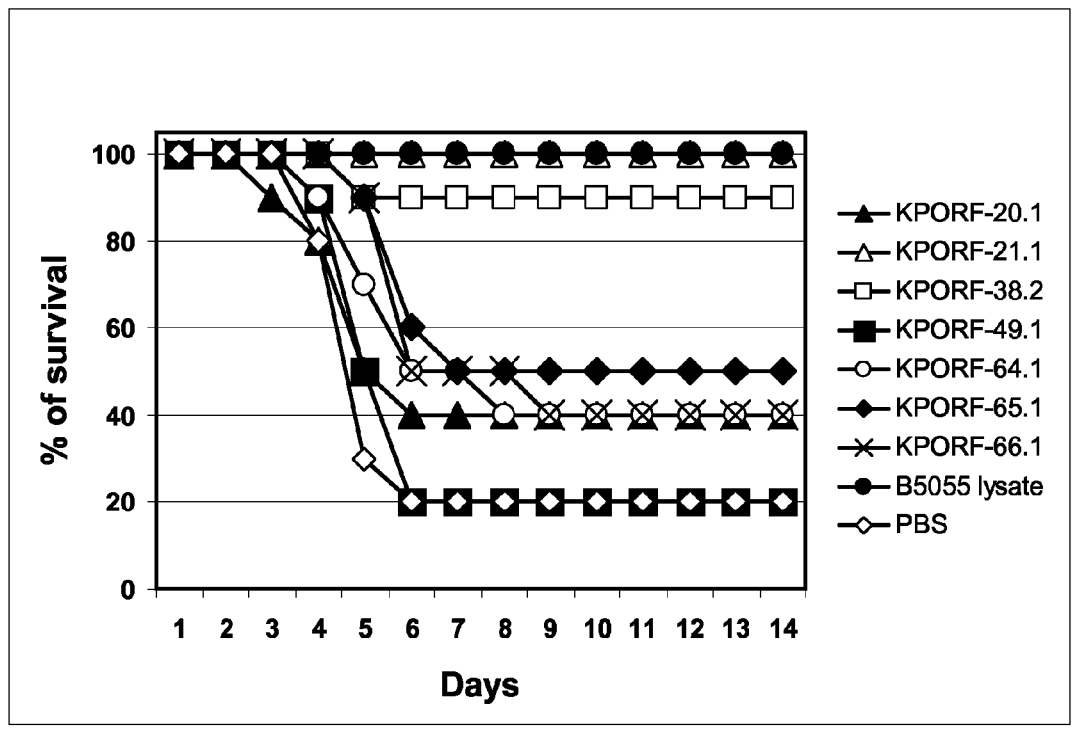
FIG. 6 shows the protection conferred by active immunization with selected *K. pneumoniae* antigens in a mouse lethality model, when CFA/IFA was used as adjuvant.
Figure 6B:
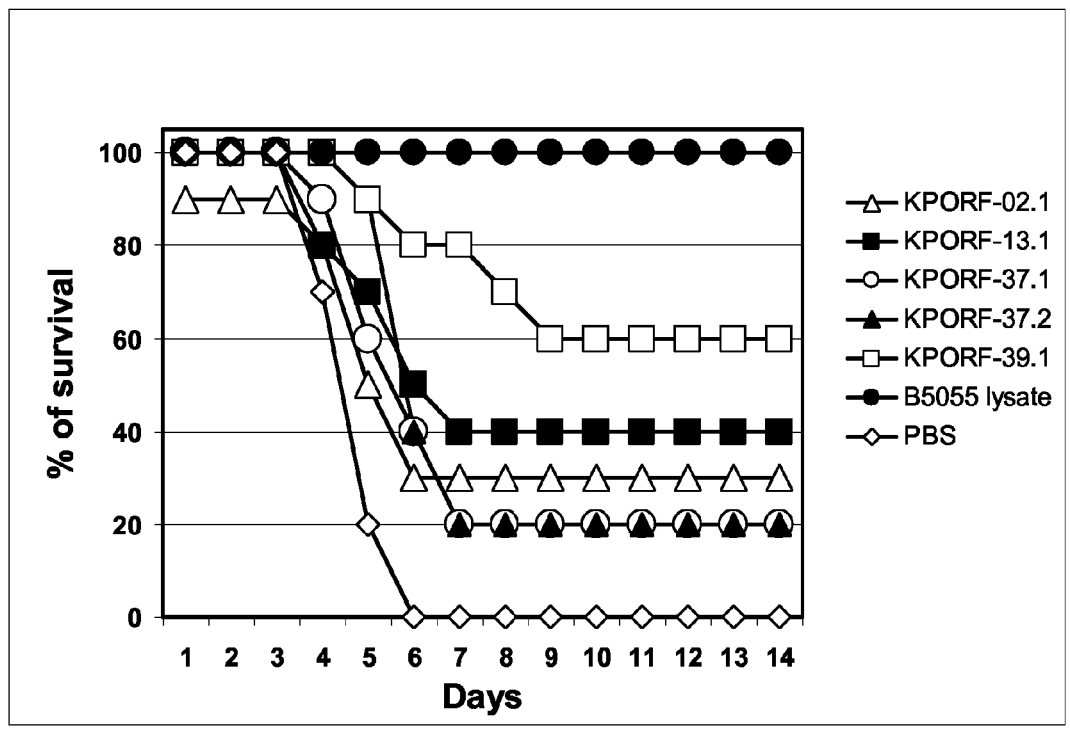
Figure 6C:
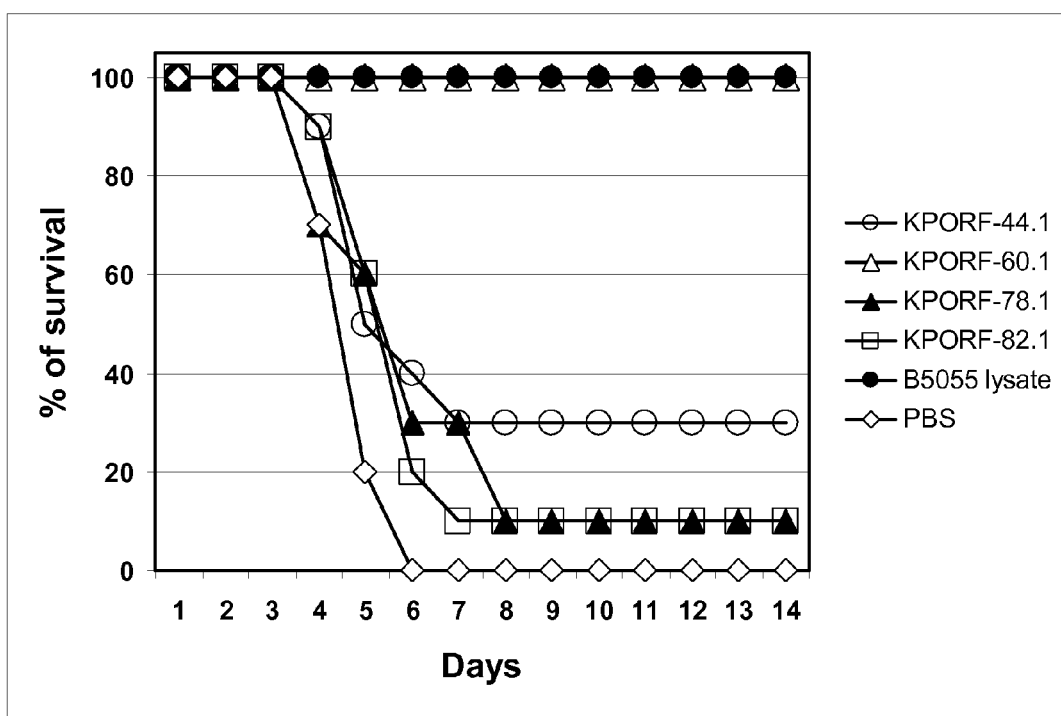

Partial protection was observed for 9 ORFs; KPORF-02.1 (30%), KPORF-13.1 (40%), KPORF-20.1 (40%), KPORF-37.1 (20%), KPORF-37.2 (20%), KPORF-44.1 (30%), KPORF-64.1 (40%), KPORF-65.1 (50%), and KPORF-66.1 (40%) (FIGS. 6A, B, and C).

Figure 6D:
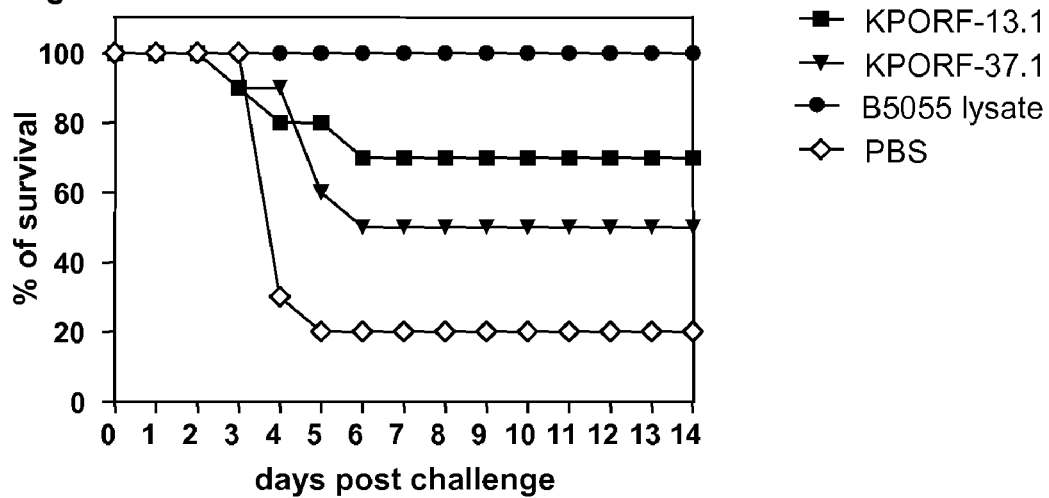

Recombinant proteins KPORF-13.1 and KPORF-37.1 were re-tested in the same model. In a single experiment, immunization with KPORF-13.1 gave protection of 70% and KPORF-37.1 gave protection of 50% against *K. pneumoniae* IP challenge (FIG. 6D).

Figure 6E:
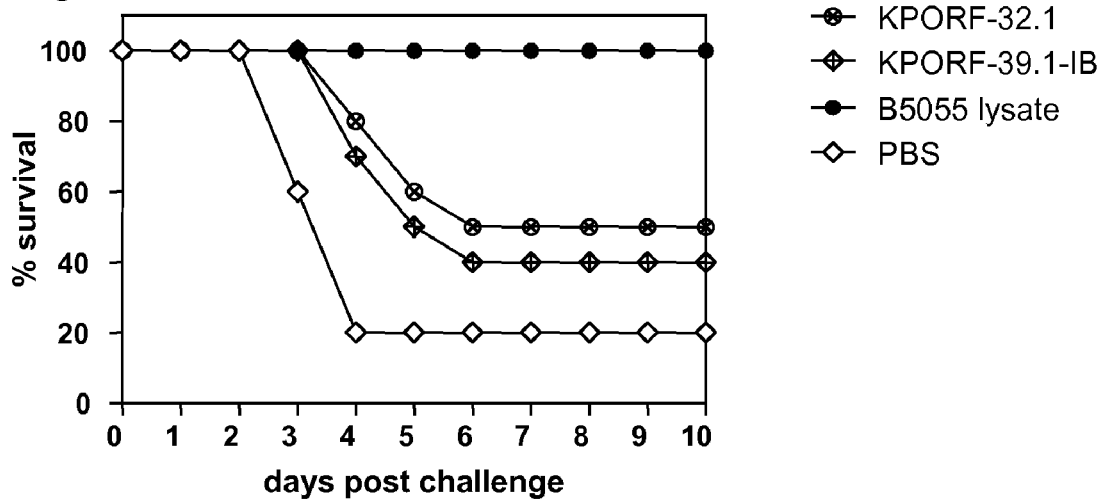

In addition, two further recombinant proteins, KPORF-32.1 and KPORF-39.1-IB (protein is the same as KPORF- 39.1 but was immunized as inclusion bodies), were tested in the same model and gave protection levels of 50% and 40% respectively (FIG. 6E). Immunization with the positive control, *K. pneumoniae* B5055 lysate, consistently gave 100% protection in all experiments.

Figure 7B:
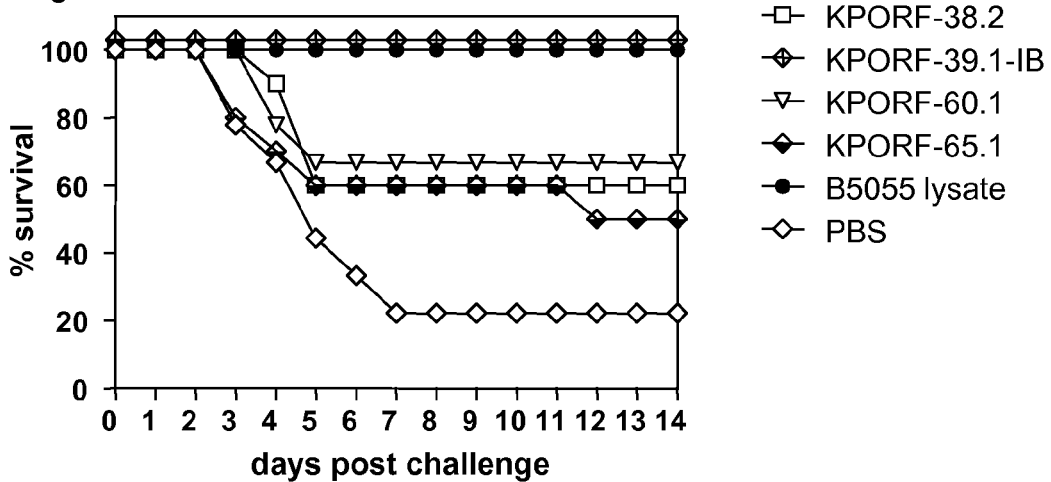

The eight *K. pneumoniae* recombinant proteins which demonstrated protection in the previously described set of experiments when adjuvanted with CFA/IFA, were re-tested in active immunization experiments using either Alum or IC31® as adjuvant. In three independent experiments in which Alum was used as adjuvant, KPORF-13.1 and KPORF-21.1 gave 60% (FIG. 7A), 50%, and 40% protection respectively. KPORF-32.1 gave 80% (FIG. 7A), 75%, and 70% protection respectively. In three independent experiments, KPORF-39.1-IB gave 100% protection (FIG. 7B, single experiment shown). KPORF-37.1 gave 40% protection (FIG. 7A), KPORF-38.2 gave 60% (FIG. 7B), and KPORF-65.1 gave 50% (FIG. 7B) protection consistently in three independent experiments (single experiments shown). KPORF-60.1 gave 67% (FIG. 7B), 58%, and 50% protection in three independent experiments.

In three independent experiments in which IC31® was used as adjuvant, protein KPORF-13.1 gave 40% (FIG. 8A), 35%, and 30% protection respectively. KPORF-21.1 gave 60% (FIG. 8B), 55%, and 50% protection. Immunization with KPORF-32.1 resulted in only 22% (FIG. 8B), 16%, and 10% survival. KPORF-37.1 gave 30% (FIG. 8B, single experiment shown) protection in three independent experiments. KPORF-38.2 gave 60% (FIG. 8A), 55%, and 50% protection in three independent experiments. KPORF-39.1-IB gave 50% (FIG. 8A), 40%, and 30% protection respectively. KPORF-60.1 gave 63% (FIG. 8A), 59%, and 56% protection respectively. Immunization with KPORF-65.1 resulted in 50% (FIG. 8B), 35%, and 20% survival respectively.

Passive Immunization Experiments

Figure 9B:
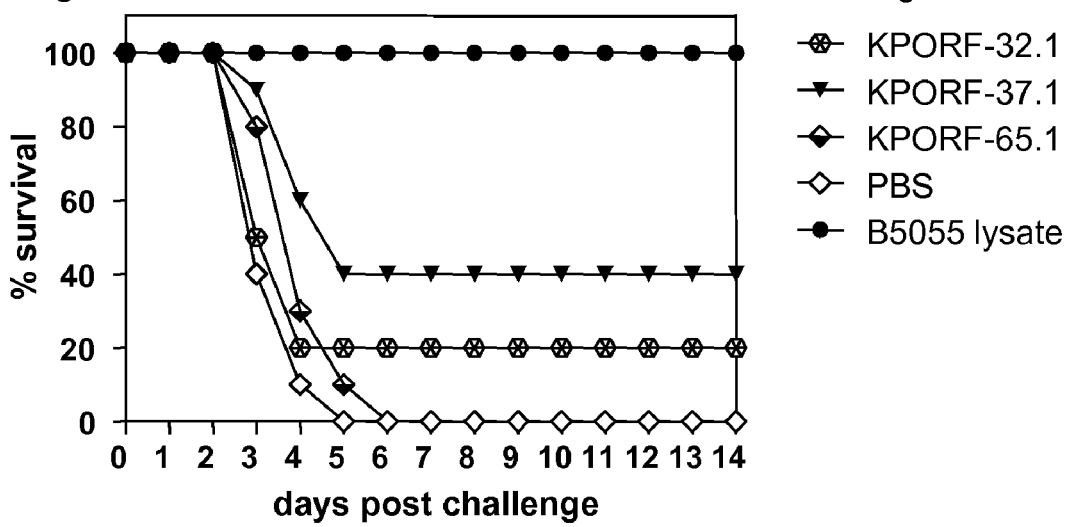

Hyper-immune rabbit sera were raised individually against *K. pneumoniae* B5055 lysate, PBS, and the eight individual *K. pneumoniae* recombinant proteins demonstrating protection in active immunization experiments; KPORF-13.1, KPORF-21.1, KPORF-32.1, KPORF-37.1, KPORF-38.2, KPORF-39.1, KPORF-60.1, and KPORF-65.1 In single experiments, passive immunization of mice with KPORF-60.1 sera gave 60% protection (FIG. 9A) and immunization with KPORF-37.1 sera gave 40% protection against *K. pneumoniae* challenge (FIG. 9B). 100% protection was observed in all mice immunized with *K. pneumoniae* B5055 lysate sera. No survival was observed in mice immunized with PBS sera (FIGS. 9A & B). 20% survival was observed in mice immunized with KPORF-32.1 sera (FIG. 9B). No protection was observed in mice immunized with sera raised against the other five proteins KPORF-13.1, KPORF-21.1, KPORF-38.2, KPORF-60.1 (FIG. 9A), KPORF-65.1 (FIG. 9B).

These antigens have not previously been shown to protect against *K. pneumoniae* infection.

Example 9

Gene conservation of *Klebsiella* Antigens

Preparation of *Klebsiella* sp. Genomic DNA 7 ml DIFCO0001 medium were inoculated with the respective strain of *Klebsiella* sp. from a frozen stab and grown without shaking at 37° C. overnight. 2 ml of the culture were then harvested by centrifuging at 13,000 rpm in a Biofuge fresco (Heraeus) for 5 min and the supernatant was removed. DNA was isolated from the bacterial cell pellets following the protocol of Wizard® Genomic DNA Purification Kit (Promega). The DNA pellets were finally dried on air and dissolved in 70 µl ddH$_2$O.

PCR amplification of *Klebsiella* sp. antigens

PCR was performed on a series of independent *Klebsiella* sp. isolates (Table 6) with primers specific for the gene of interest. Oligonucleotide sequences as primers were designed for eight antigen candidates using the public program Primer3 Whitehead, MIT, Cambridge, MA or picked manually. Oligonucleotide sequences as primers for PCR were designed for the selected antigens in order to be able to amplify the full gene. Genomic DNA of all *Klebsiella* sp. strains was prepared as described above. PCR was performed in a reaction volume of 30 µl using Taq polymerase (1 U), 200 nM dNTPs, 10 pMol of each oligonucleotide, approx. 10 to 20 ng DNA and a kit according to the manufacturers instructions (Invitrogen, The Netherlands). As standard, 30 cycles (1×: 5 min. 95° C., 30×: 30 sec. 95° C., 30 sec. 52° C., 90 sec. 72° C., 1×: 4 min. 72° C.) were performed, unless conditions had to be adapted for individual primer pairs. The PCR amplification was performed in a Biometra T3 Thermocycler. All negative PCR reactions in the first amplification round were repeated by applying optimized conditions. The DNA fragments were subsequently visualized by electrophoresis on a 1% agarose gel and stained with EtBr.

Sequence Analyses of *Klebsiella* sp. Genes

In order to determine the sequence of an antigen from diverse *Klebsiella* sp. strains, PCR was performed with primers specific for the gene of interest, as described above. *Klebsiella* sp. strains used for these analyses are shown in Table 6. Sequencing was performed with dedicated primers using the PCR products as templates. The sequences of the oligonucleotides are listed in Table 7. Genomic DNA of all *Klebsiella* sp. strains was prepared as described above. PCR was performed in a reaction volume of 30 µA, as described above, unless conditions had to be adapted for individual primer pairs. PCR samples were sequenced with the oligonucleotides as listed in Table 7. Sequencing was performed at Agowa (Berlin, Germany).

Results

The Selected *Klebsiella pneumoniae* Antigens are Highly Conserved

The PCR and sequencing of the 8 selected genes were performed as described under Methods. Table 6 shows the strains used for sequencing, while Table 7 lists the oligonucleotides employed for the PCR and sequencing analyses. Seven of the eight genes display a level of sequence identity larger than app. 93% in all analyzed strains, with the exception of KPORF-21 that is at least to a level of 83% identical. The detailed analyses of the individual genes are described separately below.

Sequence Analyses of KPORF-13

Sequences were obtained from 39 strains. The level of amino acid sequence identity ranged from 95.8% to 100% as compared to the reference sequence of KPORF-13 from *Klebsiella pneumoniae* MGH78578. Table 8 lists all 43 amino acid positions which showed a distinct amino acid as compared to KPORF-13 from *Klebsiella pneumoniae* MGH78578.

Sequence Analyses of KPORF-21

Sequences were obtained from 49 strains. The level of amino acid sequence identity ranged from 83.3% to 100% as compared to the sequence of KPORF-21 from *Klebsiella pneumoniae* MGH78578. Table 9 lists all 43 amino acid positions which showed a distinct amino acid as compared to KPORF-21 from *Klebsiella pneumoniae* MGH78578.

Sequence Analyses of KPORF-32

Sequences were obtained from 40 strains. The level of amino acid sequence identity ranged from 92.7% to 99.5% as compared to the sequence of KPORF-32 from *Klebsiella pneumoniae* MGH78578. Table 10 lists all 69 amino acid positions which showed a distinct amino acid as compared to KPORF-32 from *Klebsiella pneumoniae* MGH78578.

Sequence Analyses of KPORF-37

Sequences were obtained from 39 strains. The level of amino acid sequence identity ranged from 99.4% to 100% as compared to the sequence of KPORF-37 from *Klebsiella pneumoniae* MGH78578. Table 11 lists all 20 amino acid positions which showed a distinct amino acid as compared to KPORF-37 from *Klebsiella pneumoniae* MGH78578.

Sequence Analyses of KPORF-38

Partial sequences were obtained from 38 strains, as the nucleotide sequence encoding the very C-terminus was not successfully amplified so far (Table 12). The level of amino acid sequence identity ranged from 98.2% to 99.9% as compared to the sequence of KPORF-38 from *Klebsiella pneumoniae* MGH78578. Except for partial KPORF-38 sequences obtained from *Klebsiella* sp. strain i252/94 and *Klebsiella* sp. strain 708, all analyzed sequences comprise the corresponding amino acid sequence encompassing the KPORF-38.2 (amino acid range 582-1099) fragment of KPORF-38 from *Klebsiella pneumoniae* MGH78578.

Sequence Analyses of KPORF-39

Sequences were obtained from 50 strains. The level of amino acid sequence identity ranged from 93.1% to 100% as compared to the sequence of KPORF-39 from *Klebsiella pneumoniae* MGH78578. Table 13 lists all 29 amino acid positions which showed a distinct amino acid as compared to KPORF-39 from *Klebsiella pneumoniae* MGH78578.

Sequence Analyses of KPORF-60

Sequences were obtained from 50 strains. The level of amino acid sequence identity ranged from 94.4% to 100% as compared to the sequence of KPORF-60 from *Klebsiella pneumoniae* MGH78578. Table 14 lists all 14 amino acid positions which showed a distinct amino acid as compared to KPORF-60 from *Klebsiella pneumoniae* MGH78578.

Sequence Analyses of KPORF-65

Sequences were obtained from 48 strains. The level of amino acid sequence identity ranged from 98.3% to 100% as compared to the sequence of KPORF-65 from *Klebsiella pneumoniae* MGH78578. Table 15 lists all 27 amino acid positions which showed a distinct amino acid as compared to KPORF-65 from *Klebsiella pneumoniae* MGH78578.

References

The following references which have been recited in the present specification in a truncated version are incorporated herein by reference in their entirety.

Altschul, S., et al. (1990). *Journal of Molecular Biology* 215: 403-410.
Amit, A. G., et al. (1986). *Science* 233: 747-753.
Bennett, D., et al. (1995). *J Mol Recognit* 8: 52-58.
Carter, P., et al. (1985). *Nucl. Acids Res.* 13: 4431-4443.
Clackson, T., et al. (1991). *Nature* 352: 624-628.
Cohen, J. (1993). *Science* 259: 1691-1692.
Cryz, S. J., et al. (1986). *Vaccine* 4: 15-20.
Current Protocols in Molecular Biology, John Wiley and Sons, Inc. (1987).
Devereux, J., et al. (1984). *Nucleic acids research* 12: 387-395.
Doherty, E., et al. (2001). *Annu Rev Biophys Biomol Struct* 30: 457-475.
Eisenbraun, M., et al. (1993). *DNA Cell Biol* 12: 791-797.
Etz, H., et al. (2001). *J Bacteriol* 183: 6924-6935.
Ganz, T. (1999). *Science* 286: 420-421.
Georgiou, G. (1997). *Nature Biotechnology* 15: 29-34.
Haeggman, S., et al. (1997). *Antimicrob Agents Chemother.* 41: 2705-2709.
Hashemzadeh-Bonehi, L., et al. (1998). *Mol Microbiol* 30: 676-678.
Heinje, von G. (1987). Sequence Analysis in Molecular Biology, Academic Press.
Hemmer, B., et al. (1999). *Nat Med* 5: 1375-1382.
Hornef, M., et al. (2002). *Nat Immunol* 3: 1033-1040.
Huse, W. D., et al. (1988). *Science* 246: 1275-1281.
Ishibashi, S., et al. (1993). *J. Clin. Invest.* 92: 883-893.
Johanson, K., et al. (1995). *J Biol Chem* 270: 9459-9471.
Jones, P., et al. (1986). *Nature* 321: 522-525.
Kajava, A., et al. (2000). *J Bacteriol* 182: 2163-2169.
Kay, M., et al. (1994). *Proc. Natl. Acad. Sci. USA* 91: 2353-2357.
Kohler, G., et al. (1975). *Nature* 256: 495-497.
Kolaskar, A., et al. (1990). *FEBS Lett* 276: 172-174.
Kurupati, P., et al. (2006). *Proteomics* 6: 836-844.
Lewin, A., et al. (2001). *Trends Mol Med* 7: 221-228.
Marks, J., et al. (1992). *Biotechnology* (N Y) 10: 779-783.
McCafferty, J., et al. (1990). *Nature* 348: 552-554.
Nagy, E., et al. (2003). Identification of the "antigenome"—a novel tool for design and development of subunit vaccines against bacterial pathogens. In Genomics, Proteomics and Vaccines (G. Grandi, ed), John Wiley & Sons Ltd., UK.
Okano, H., et al. (1991). *J Neurochem* 56: 560-567.
Oligodeoxynucleotides as Antisense Inhibitors of Gene Expression; CRC Press, Boca Raton, Fla. (1988).
Ørskov, I. (1984). Genus *Klebsiella*, p 461-465. In N. R. Krieg and J. G. Holt (ed.), Bergey's manual of systematic bacteriology, vol. 1. The Williams & Wilkins Co., Baltimore, Md.
Parchuri, S., et al. (2005). *Heart Lung.* 34:360-363.
Podschun, R., et al. (1998). *Clinical microbiology review.* vol. 11:4:589-603.
Queen, C., et al. (1989). *Proc. Natl. Acad. Sci. USA* 86: 10029-10033.
Rammensee, H., et al. (1999). *Immunogenetics* 50: 213-219.
Remington's Pharmaceutical Sciences, by E. W. Martin, Mack Publishing Co., Easton, Pa., 15th Edition (1975).
Riechmann, L., et al. (1988). *Nature* 332: 323-327.
Seeger, C., et al. (1984). *Proc Natl Acad Sci USA* 81: 5849-5852.
Skerra, A. (1994). *Gene* 151: 131-135.
Stamm, W. E, et al. (1981). Comparison of endemic and epidemic nonsocomial infection. Nosocomial infection. Yorke Medical Books, Atlanta. Ga. p. 9-13.
Tang, D., et al. (1992). *Nature* 356: 152-154.
Tempest, P., et al. (1991). *Biotechnology* (N Y) 9: 266-271.
Tourdot, S., et al. (2000). *Eur J Immunol* 30: 3411-3421.
Ueda, Y., et al. (2005). *Antimicrob Agents Chemother.* 49: 4185-4196.
Wells et al. (1986). *Philos. Trans. R. Soc. London Ser.A* 317: 415.
Wells, J. A., et al. (1985). *Gene* 34: 315-323.
Wu, L. T., et al. (2005). *Clin Microbiol Infect.* 11: 893-897.
Yadav, V., et al. (2005). *Folia Microbiol* (Praha) 50: 83-86.
Zoller, M. J., et al. (1987). *Nucl. Acids Res.* 10: 6487-6500.

The features of the present invention disclosed in the specification, the claims and/or the drawings may both separately and in any combination thereof be material for realizing the invention in various forms thereof.

SEQUENCE LISTING (768 sequences)

SEQ ID NO: 1 - DNA, 387 bp, Klebsiella pneumoniae
ttttcatacattatgctgggaacgaacgatctgccacgcgccatcaagttctatgacccgttaatggcgctgctgggacacgtcaaagccggccgtaacgaacagggggcgtcctggggcaccttcaacggcaatcacacctgcgggctgtgcgtgggtgttccttttgaccagcagcctgccggggtgggtaatggaacgatggtggcgcttaacgcccgctccgtcgcacatattgcggaactgcatgccctcgccctgcaactcggcggacgtgacgaaggcggtcccggtcaccggccgcagtatggcgacggttttcacagcgcctacgtccgcgatcccgacggcaataagctggcgtttgtttactatgcgtcggcagat

SEQ ID NO: 2 - DNA, 993 bp, Klebsiella pneumoniae
gctgataaaatggtcatcgcccaccgcggcgccagcgggtatctgccggaacataccctgccggcgaaagcgatggcttacgctcagggggcggattaccttgagcaagacctggtgatgaccaaagacgaccggctggtggtgttacacgaccactatctcgatcgggtgactgacgttgcgcagcgtttcccgcagcgggcgcgtaaagatggccgtttctacgccatcgactttaccctggacgagattaagtcgctgaagttcaccgaaggttttgagccgaaaaatggtaagaacgtgcaaacctatcccgggcgattcccgatgggcaaatccgatttccgtattcatacctttgaagaggagattgagtttgtccaggggctgaaccattcaaccggcaaaaacatcggtatctacccggaaatcaaagcgccgtggttccaccaccaggaaggcaaagatattgccgccagcacattgaaggtgctgaaggaatatggctataccagcaagcaggataaggtttatctgcagtgctttgacgccaacgagctcaaacgcattaaaaatgagctggagccgaagatggggatggatctcaatctggtgcagctcatcgcctataccgactggaatgaaacccagcagaaacaggccgatggtaagtgggtgaactacagctatgactggatgttcaagccaggggcgatggcgcagattgcgcagtacgcggacggtatcggcccggattaccatatgctggtagcggaaggctcgaagccgggggcggtgaagctgacggcgatggtgaaagaggcgcatgccagccatctgcaggtgcatccgtacaccgtgcgcgcggatcagttgccggagtacgcgactaacgttaatcagctctatgacgtgctgtataaccaggcgggcgtcgacggcttatttaccgatttcccggataaagcggtgcagttcctggacgcgaaacgc

SEQ ID NO: 3 - DNA, 537 bp, Klebsiella pneumoniae
ctattaatgcaacgaatcacaaagctggataacgacttaacctgtaagggaatgctgatgaaactctggaataaaacactactcgcttccgccctgtgcctgaccctgtttggctgcgacgatgcgtcgaaagttgataacaaactggataaggctaaagataatgcggagcagatgaaggatgccgcggcggataaagcgcaggcaattaaacaggatgcggataaacaaatcgatacgctgaaaagccaggctgacgccgaggccgatcgcctgaaggatcaggccagcgccatcaaggccgaggcggacaagaaggcggacgccatcgcccagcaggcgaaagcccaggccgatgcggtgaagcagaacgcaaagcaggaaagtgaccgcatagtcaaagaggcgggtcagatcaaagacaacgccatcggtgacgccaatcagctctcggctgaagcggcgagcaaaaccaaagccatccaggacagtatcgcgaaggataaacagaacgccgcgccgcctgccgcacagcag

SEQ ID NO: 4 - DNA, 504 bp, Klebsiella pneumoniae
gtgcctgtgactgaaccttcatcacgccgctccggctacgcccgcctgctggaccgtgctatccgcattctggcgatgcgcgaccacagcgagcaggagctgcgacgcaagctggtcgctccggtgatgagcaaaaacggtcctgaggcgctggacgtcacccccgacgagctggagcaggttgtcgcctggtgtatcgaaaaccgctaccttgacgacaaccgcttcgtcggccagttcatcgccagccggagccgcaaaggctatggtccggcgcgcattcgccaggagctcagccagaaaggcattgcgcgccaggtcgttgaccaggcgatgcgcgaatgcgatatcgactgggtgagccttgccagggagcaggcacagcgtaaatacggcgaaccgttaccttccgcctttactgaaaaagtgaaagttcagcgattcctgctttaccgcggctacctgatggaagatatccaggaaatctggcgaaattttgcagat

SEQ ID NO: 5 - DNA, 1257 bp, Klebsiella pneumoniae
agcaaagtcagaatcgctattatcggtaacggcatggttggccatcgctttatcgaagagcttctcgataaggcgcctgccggacagttcgacattaccgtgttctgtgaagaaccgcgtatcgcctacgaccgcgtccacctgtcgtcttatttctcccatcacactgcggaagaactgtcgctggtacgcgaaggtttctatgagaaacacggcgtcaaggtgctggtcggcgaacgggcgatcaccatcaaccgccaggagaaagtgatccactccagcgccgggcgtaccgtgttctacgacaagctgattatggcgaccggttcatacccgtggatcccgccgattaaaggcgcggaaacccaggattgcttcgtctatcgcactattgaagatcttaacgccatcgaatcctgcgcccgccgcagcaaacgcggcgcggtagtcggcggcggcctgctcggcctggaagcggccggagcgttgaaaaacctcggcgtggaaacccatgttatcgaattcgcgccgatgctgatggccgaacagctcgaccagatgggcggcgagcagttgcggcgcaaaatcgaaagcatgggcgtgaaagttcacaccagcaaaaacaccaaagagattgttcagcagggcaccgaggcgcgcaaaaccatgcacttcgccgacggtagcgagctgcaggtcgatttcatcgtcttctcaaccgggatccgcccgcgcgataagctggccacccagtgcgggctggcggtcgcccagcgcggcggcatcatggtcaacgatagctgccagacctccgatccggatatctatgccatcggggaatgcgccagctggaacaaccgcgtctacggtctggtcgcccccggctataaaatggcccaggtggccgtcgaccatctcctcggcagtgaaaatagcttcaccggcgccgacctcagcgccaagctgaagctgttgggtgtggacgtgggcgggatcggcgatgcccacggccgcacgccgggcgcccgtagctacgtctatctcgacgaaagcaaagaagtttataagcgcctgatcgtcagcgccgacaacaaaacgctgctcggcgcggtactggtcggcgacaccagcgactacggcaatctgctgcagctggtgctcaacgccatcgagctgccggaaaacccggattcgctgatcctcccggcccacgccggcagcggcaagccatcgatcggcgtggataaactgccggac

SEQ ID NO: 6 - DNA, 1302 bp, Klebsiella pneumoniae
ggcgtggataaactgccggacagcgcgcagatctgctcctgctttgacgtcagcaaaggcgacctgatcgccgctatcaacaaaggctgccacaccgtggcggcgctgaaagcggaaaccaaagccgggaccggctgcgggggctgtattccgctggtcactcaggtgctcaacgccgagctggcgaaacagggcattgaggtcaacaacaatctgtgcgaacacttcgcttactcccgtcaggagctgttccacctgatccgcgtggaaggcatcaaaaccttcgacgagctgctggaaaaacacggtcagggctacggctgtgaagtctgtaagccgaccgtcggttccctgctggcctcctgctggaatgagtacatcctcaagccgcagcacacgccgctgcaggacagcaacgacaacttcctcgccaacattcagaaagatggtacctattcggtgatcccgcgctcagctggcggcgaaatcacgccggaagggctggtcgccgtgggccgtatcgcgcgtgaattcaatctgtacaccaaaatcaccggctctcagcgcatcggcctgtttggcgcgcagaaagacgacctgccggagatctggcggcagctgattgaagcgggattcgaaaccggccacgcctacgccaaagcgctgcgaatggcgaaaacctgcgtcggcagcacctggtgccgctacggcgttggcgacagcgtcggcttcggcgtggaactggaaaaccgctacaaaggcatccgcaccccgcacaaaatgaagttcggcgtctccggctgcacccgcgaatgtgccgaggctcagggcaaagacgtcgggatcatcgccaccgagaaaggctggaacctgtacgtttgcggtaacggcgggatgaaaccgcgccacgccgatctactggccgcggacctcgatcgcgagacgctcatcaaatatctcgaccgctttatgatgttctacatccgcaccgccgataagctgacccgcactgccccgtggctggacaatatggaaggcggtatcgactatctgcgcagcgtcatcatcgatgacaagctcggtctgaacgaccatctggaagaagaactggctcgcctgcgcgccgccttcgcctgcgagtggaccgagaccgtcaacaacccggcggcgcagacccgcttcaaacactttatcaacagcgaccagcgcgacccgaacgttcaggtggtgccggaacgtgaccagcaccgcccggccacgccgtatgagcgtatcccggttactctggtggaggaaaaagca

SEQ ID NO: 7 - DNA, 1554 bp, Klebsiella pneumoniae
gtgaccacctcaagccagtggcaggatagccattcgccgctgcaggtggtgttgcaggccagcctgctggaatccggcggtcgcccggtgacccgtacggttaagcagccgatctggcccgccgaggcgctgccggggatccgcccgcaatttacgctgaaggacgtttacgattaccgcaccgataccaccgtcaaacagccggtggtggatgaaaacagtaacgccgcgtttgatatcgtctatgccgacgtcaaaggcgagaaaaaagcgatctccggtctccaggtgcggctgatccgcgagcggcgcgactactactggaactggtccgacagcgaaggttggcagtcgcagttcgatcaaaaagatctgcaggagggcgaggagtcgctggacctgcaggccggccagatcggcaaagtgagcttcccggtggagtggggatcctatcgcctggaggtgaaaggaccggacgacgtggtcagcagcgtgcgcttctgggcgggctacagctggcaggataacagcgaaggcgccggcgcggcgcgtcctgaccgggtcaccatgaagctggataaaccgagctataaaccgggcgacaccatcaggctgcacatcgccgccccggcggcgggtaaaggctacgcaatggtggaatccagcgaagggccgctgtggtggcaggaaattgacgtcccggcggaggggatggacctgtcgatcccggtggataaaacctggaatcgccacgacctctacctcagcacgctggtggttcgtcccggcgataaatcgcgctcggcaacgccgaaacgcgcggtgggcctgctgcatctgccgctgggcgatgaaaaccgtcgcctgacgctggcgctggaggccccggacaaaatgcgccccaaccagccgctgacggtgaaagtgaaagccagcgtcaaagagggcgaggcgccgaaacaggtcaatgtcctgctctcggcggtggatagcggggtactgaatatcaccgattacgctaccccggatccgtggaacgccttctttggccagaagcgttacggcgcagatatctatgacatctacggccaggtgatcgaagggcaggggcgggtggccagcctgcgcttcggcggcgatggcgacgagttaaaacgcggcggcaaaccgccggtcaaccacgtgacgatcgtcgcccagcaggcgcagccggtggtattgaacgatcagggcgaaggcacggtgacgttacccattggcgattttaacggcgagctgcgggtgatggcccaggcgtggacggcggatgacttcggcagcagcgaagataaagtggtggtggccgccccggtcatcgccgaactgaacaccccgcgcttcctcgccagcggcgataccacacggctggcgctggatctcagcaatctgaccgataaaccgcaaaccctgcaggttcatcttaccgccagcgggctggtgaccttgaccgagggtcaactgccgccggtgcaactggcgccgggggcgcgcagcacgctgtttataccagtgagc

SEQ ID NO: 8 - DNA, 735 bp, Klebsiella pneumoniae
gtggatggatggcagcgcgcctttgtcctgcatagccgtccgtggagcgaaaccagcctgatgctggacgtcttcacggaagaatccggtcgtgtgcgcctggttgccaagggcgcacgctccaaacgctctaatctcaaaggcgctttacagccctttacccccttgctggttcgcttcggcggtcgcggcgaagtcaaaaccctgcgcagcgcggaagccgtttcgctggcgctgccgctcagcggcatcaccctctacagcggtctctacgttaacgagcttatctcccgcgtgctggagcacgaaacacgcttctccgaactctttttcgactacctgcactgcattcaggcgctcgccggggccagcggctcgccggagcccgcgctgcggcgttttgagctggcgctgctcgggcacctggggtatggcgtggattttctccactgcgccgggagcggcgagccggtagacgacaccatgacctaccgctatcgtgaagaaaaaggctttattgccagcctggtgattgataacaacacgtttaccgggcaccatttgaaagcattggcgagtcgcgagtttcctgatgttgatacgctgcgcgccgcgaagcgctttacccgtatcgccctgaagccctatctcggcggcaaaccgctcaagagccgggagttgtttcgccagtttatgcccgcgcgaaaggcgcgagccgataatacgaataatgat

SEQ ID NO: 9 - DNA, 2040 bp, Klebsiella pneumoniae
gtcaagtcgttaagggcatggccttcaacagtccgaactggagtcaaaatgtcctcacgtaaagagcttgctaacgctattcgtgcgctgagcatggacgctgtacagaaagccaaatccggccacccgggggccccgatgggtatggctgacattgccgaagtgctgtggcgtgatttcctgaaccataacccgaacaatccggcctgggctgaccgtgaccgttttgtgttgtcaaatggccatggttcgatgctgatttacagcctgctgcacctcactggctacgatctgccgattgaagagctgaaaaacttccgccagctgcactccaaaaccccgggtcacccggaagtcggctacaccgcaggcgtggaaaccaccaccggtccgctgggccagggtatcgctaacgcggtcgggatggctatcgccgagaaaaccctggcggcgcagttcaaccgtccgggacacgatatcgtcgaccactacacctacgccttcatgggcgacggctgcatgatggaaggcatttctcacgaagtgtgctccctggccggtaccctgaaactgggtaaactggtggcgttctatgatgacaacggcatctccatcgacggccacgttgaaggctggttcaccgacgacaccgccaaacgctttgaagcctacggctggcacgtggtgcgcggcgtggacggtcacgacgctgacgccatcaaacgcgcggtagaagaagcgcgggcggtcaccgacaaaccgtccctgctgatgtgtaaaaccatcatcggtttcggttcgccgaacaaagccggtacccacgactcccacggcgcgccgctgggcgacgccgaaatcgccctgacccgcgaagcgctgggctggaaacacgcgccgtttgacatcccgtctgacatctatgcccagtgggatgccaaagaagccggccaggcgaaagaagccgcatggaacgagaagtttgcggcttacgccaaagccttcccgcaggaagcagccgaattcacccgccgtatgaaaggcgagatgccgtctgacttcgacgcgaaagctaacgagttcatcgcgaagctgcaggccaacccggcgaaaatcgccagccgtaaagcctcgcagaacgccatcgaagccttcggcccgctgctgccggaattcctcggcggctccgcagatctcgcgccgtccaacctgaccctgtggtccggctctaagccgatcaacgaagacgctgccgggaactacatccactacggcgtgcgcgagttcggtatgaccgctatcgccaacggtatcgcgctgcacggcggcttcctgccgtacacctccaccttcctgatgttcgtggaatacgcgcgtaacgcggtacgtatggccgcgctgatgaaacagcgtcaggtgatggtctacacccacgactcgatcggtctgggcgaagacggcccgactcaccagccggtagagcaggtggcttccctgcgcgtgaccccgaacatgtccacctggcgtccgtgtgaccaggttgaatccgcgattgcgtggaaatatggcgtggagcgtcaggacggcccgaccgcgctgatcctctcccgtcagaacctggcgcagcaggagcgtaccgcagagcagctggcgaacgtggcccgcggcggttatgtgctgaaagagtgcaccggctcgcagccggagctgatcttcatcgccaccggttcagaagtggagctggcggttgccgcatgggacaaactgactgccgaaggcgtgaaggcgcgcgtggtttccatgccgtccaccgacgcgttcgacaagcaggatgcggcttatcgcgaatccgtactgccgaaagccgtgaccgcgcgcgttgccgtggaagcgggtatcgctgactactggttcaaatacgttggcctgaacggcgctatcgttggcatgaccaccttcggtgagtctgcgccggctgagcagctgttcgaggagttcggcttcaccgttgataacgtggtcgctaaagcgaaagcgctgctg

SEQ ID NO: 10 - DNA, 918 bp, Klebsiella pneumoniae
gaagttaaaatcgcccttgtggcgaaatcgctgggaaatggcttcttcgaagccgccaacgttggcgcccaacaggcagccaaggagttaggtgatgtcaaagtgatctacaccggcccgaccactaccaccgccgaggcgcagatcgacgtgctgaacgggttgatcgcccagggggtggatgcgatcgccatttccgccaacgatccggacgcggtggtgccggtgctgaaaaaagcgatgcagcgcggcatcaaggtggtctcatgggactccggcgtggcgccggcaggccgtcagatccatcttaacccctcaaataacgccttaattggcgaaaccaacgtcaagcttgccgccgatgcgctgcaggcgctgaacgttgagaaaggcgaggtggccgtgttaagcgccaccccaacctccacgaaccagaacatctggattgaggagatgaaaaaggtgctaccgcagtatccgtcggtgcagctggtcaccgtcgcctacggtgacgatctgtcggataaaagctaccgcgaagcggtgggtctgctgaaatcatatccggacctgaaagtcattgtctcgccgtcgtcggtggggattgttgccgccgcgcaggcggtgaaggaccagggcaaaatcggcaaagtgtatgtcaccgggctggggctgccgtcggaaatggccggcgcgatcaagtccggcgccagcaaaagcttcgccatctggaacccgattgacctgggctacgccgccacctatctggccgacgatttagtcaaaggcacggcgaccaaaaccgaagccagtatgggcaagctgggcaaagtgaatctggacgccgaggggaatggcgcgatggccaagccgtttgtctacgatgcgagcaacatcgataagttctcgaaaattttc

SEQ ID NO: 11 - DNA, 678 bp, Klebsiella pneumoniae
gctaataagaccctggttgtcgccaccgatacggcgttcgtcccgttcgaatttaagcaaggcgataagtatgtgggttttgacgttgacctgtgggcggctatcgccaaagagctgaagctcgactacaccctgaagccaatggacttcagcggcattatcccggcgctgcaaaccaaaaatatcgatctggcgctggcggggatcaccattaccgacgagcgtaaaaaagcgatcgacttctccgacggctactacaaaagcggcctgctggtgatggtcaacgccaataataacgacatcaaagatgtcaaagatctgaacggtaaagtggtcgcggtgaagagcggcaccggctccgttgactacgcgaaagccaatatcaaaaccaaagatctgcgtcagttcccgaacatcgataacgcctatatggagctgggaaccggtcgcgcggatgccgtgctgcacgatacgccgaatattctgtacttcatcaaaaccgcgggcaacggtaagttcaaagcggtaggcgaatcactggaagcgcaaaactacggtatcgccttcccgaaaggcagcgacgagctgcgtgagaaagtgaacggtgcgctgaaaacgctgcgcgacaatggtacctataacgaaatttataaaaaatggttcggcactgaacccaaa

SEQ ID NO: 12 - DNA, 1002 bp, Klebsiella pneumoniae
cggttcatctggctctatacggaattgaaaaacgctcccacattaaaaacgtattcagccgccgtggactggaacgtccccggccactattttgcagaaaccttttcgcgttctggaatgaacccgtctggccaatccatcaggggtgaaataatgaaaaaatcattggcatcaatgtgtctgagcgctgtattaacggtcgctttttcttatcacgccgtcgcggccgatcttccggaaatagaaaaatccggcaccttgaaagtggcgacggaagatgattatgcgccgtttaactttatgaataatggccaggctgatggctttaacaaagatatgcttgaggaattacgtaagtacgcaaaattccatgtcgaccagagcatattaccgtggaccggattattagcggctgtctccaccgggcaatacgatatggccttaaccggggcggttattaccgatgagcggctgaaggtctttgatttcaccccaccgtgggcctccgcgcagcactatttcgtcaaacgcgctggcgatacctcgctaaataccattgccgatctcagcggcaaaaaagtgggggtacaggccgggagcgcgctgctggcgcgtttgccggagctgaaggcgatgctggagaagaccggcggcaagctggggccggtggtggagtatccctcctatccggaagcctacgccgacctggcgaacaagcgactggattacgtgattaacgtggtgatctcggtaaacgacctggcgaaagccaaaccgaaggtcttcgccaaagggctggccgtctccggaccggggtatatggcgtggccgatcccgaaaaactcgccgcagctgctggcctatatgaccaggtttatgaaccacatgaaggagaccggcaagctcgccgaactgcagaaaaaatggttcggcgaaacctatgacaacctgccgaccgaggcgatcaccagcccggaacagtttcacaaactcgccggactg

SEQ ID NO: 13 - DNA, 1788 bp, Klebsiella pneumoniae
aacctgtacaatgtgcaaatcgttcgcttcgacgactatcagacgcgctcgaacgaaaaccgcatcaagctggtgccgatcccgccgagccgcggcattatttacgatcgcaacggcaccccgctggcgcttaaccgcaccatttaccagctggagatgatgccggagaaagtcgataacgtacagcagacgctggatgcgctacgcgacgtcgtcgatttaaccgacgatgacatcgccggtttcaaaaaggagcgcgcccgctcccatcgttttacctcgattccggtaaaggtcaacctcagcgaagtgcaggtggcccgctttgccgtcaaccagtaccgctttcccggcgtggaagtcaaaggctacaagcgtcgttattacccctataattcggcgctgactcacgtcattggctatgtctcaaaaattaacgataaagacgtcgaccgcctggataaagagggcaagctggccaactacgcctcgacgcacgacattggtaagctgggtatagagcgttattacgaggacgttctgcacggtcagaccggctacgaagaggttgaagtgaacaaccgcggccgcgtcattcgtcagctgaaagaggtgcctccgcaggccggacgcgacatttacctcaccctcgacctcaagctgcagcagtatattgaaacgctgctggccggcagccgcgccgccgtggtggtgaccgacccgcgtaccggcgctattctggcgctggtttcaaccccgagctatgacccgaacctgttcgtcgacggcatctccagcaaagattactccgcgctgctcaacgacccgaacacaccgctggtcaaccgagcgacgcagggggtctatccgccggcgtcgacggtcaaaccgtacgtcgccgtctcggcgctgagcgccggggtgatcacccgcaacaccagcctcttcgaccccggctggtggcagttgcctggctcagagaaacgctatcgtgactggaaaaagtggggccacggccatctgaacgtcaccaaagcgctcgaggagtctgcagatacctatttctaccaggtcgcctatgacatgggcatcgaccgtctctcagagtggatgagcaagtttggctacggccactacaccggtatcgacctctccgaggagcgctctggcaacatgccgacccgcgaatggaagctcaagcgctttaagaaaccctggtaccagggggacaccattccggtgggcatcggccagggttactggaccgccacgccgatccagatgaacaaagcgctgatgatcctgattaacgacggcgtggtgaaggtgcctcatctgctgcagagcaccgtggaagacggcaagcccgtaccctgggtccagccccatgagccgccggtaggcgatatccattccggctattgggaaatcgccaaagacggcatgtacggcgtggccaaccgcggcaacggcaccgcgcacaaatacttcgccagcgcgccgtataaaatcgcggccaagtcaggtaccgctcaggtgttcggcctgaaggccaacgaaacctataacgcgcaccggatctccgagcgcttgcgcgaccataaactgatgacagcgtttgcgccttataacaacccgcaggttgccgtggcgatgattctggaaaacggcggcgccggcccggcggtcggtacgattatgcgccagatcctcgatcacatcatgctgggcgataacaacactacgctgccaagcgaaaacccggcggtaaccgcaggggaggatcaa

SEQ ID NO: 14 - DNA, 2151 bp, Klebsiella pneumoniae
gcggaaaccgccaccgacgataaaaacagcgccgctgaagagaccatggtggtcaccgccgccgagcagaacctgcaggcgccgggcgtctccaccatcaccgccgatgagatccgcaaacgccccccggcgcgcgacgtctcggagatcattcgcaccatgccgggagtcaacctgaccggcaactccaccagcggccagcgcggcaacaaccgccagattgatatccgcggcatgggcccggaaaataccctgatcctgatcgacggcaagccggtcaccagccgcaactccgtgcgccttggctggcgcggcgagcgcgacacccgcggcgataccagctgggtgccgccggagatgatcgaacgcatcgaagtgattcgcggcccggccgccgcccgctacggcaacggcgccgccggcggcgtggtgaatatcatcaccaaaaaaaccggcgatgagtggcacggctcatggaacacctatatgaacgccccggagcacaaggatgaaggctccaccaaacgcactaacttcagcctcagcggcccgctgggcggcgattttagcttccgcctgttcggtaacctcgacaaaacgcaggccgacgcctgggatatcaaccagggccatcagtccgagcgtaccgggatctatgccgatactctgccggccgggcgcgaaggggtgaaaaacaaaaacatcgatggtctggtgcgctgggaattcgctccgatgcagtcgctggagtttgaggccggctacagccgccagggcaacctctacgccggcgacacccagaacaccaactccaacgacctggtaaaagagaactacggcaaagagaccaaccgtctgtatcgcaacacctactcggttacctggaacggcgcctgggacaacggggtgaccaccagcaactgggcgcagtacgaacgcacccgcaactcgcgcaaaggcgaaggcctggccggcggcaccgaggggatctttaacagcaaccagttcacggatatcgatctggcggatgtgatgctgcacagcgaagtcagcattcccttcgactatctggttaatcagaacctgacgctgggcagcgagtggaatcaacagcggatgaaggataacgcgtccaacacccaggcgctgtcgggaggcgaaattccgggctacgacagcaccggccgcagcccgtactcgcaggcggaaatcttctcgctgttcgccgagaacaacatggagctgaccgacaccaccatgctgactccggcgctgcgtttcgatcatcacagcattgtcggcaataactggagcccgtccctcaacctgtcgcagggcctgtgggatgacttcacgctgaagatgggcatcgcccgcgcctataaagcgccgagcctgtatcagaccaacccgaactacattctctacagtaaaggccagggctgctacgccagtaaagacggctgctatctgcagggtaatgacgacttaaaagccgagaccagcatcaacaaagagattggcctcgagtttaaacgcgacggctggctggcgggcgtcacctggttccgcaacgactaccgcaacaagattgaagcgggctatgccccggtctatcaaaacaataaaggtaccgatctctaccagtgggaaaacgtgccgaaagcggtggtggaaggtctggaggggacgttgaacgttccggtgagcgagaccgtcaactggaccaacaacatcacctatatgctgcagagtaagaacaaagagaccggcgatcgtctgtcgattatcccggaatacacgctgaactccaccctgagctggcaggttcgcgatgacgtttcgctgcagtcgaccttcacctggtacggcaagcaggagccgaagaagtacaactacaagggtcaaccggtcaccggcagcgagaagaacgaggttagcccctacagcatcctcggcctgagcgcgacctgggacgtcaccaaatacgtcagtctgaccggcggcgtggataacgtcttcgataagcgccactggcgcgcgggcaacgcccagaccaccgggggcgccaccggcacgatgtacggcgccggcgccgagacctacaatgaatcgggccgcacctggtacctgagcgtcaacacccacttc

SEQ ID NO: 15 - DNA, 1212 bp, Klebsiella pneumoniae
gtcgattttcatggctacgcgcgttccggcattggctggaccggcagcggcggcgagcaacagtgcttcaaagcgaccggcgctcaaagtaaataccgtcttggtaacgaatgtgaaacctatgcggaactgaagctgggccaggagctgtggaaggaaggggataagagtttttatttcgatactaacgttgcctattccgtgaatcaggaagatgactgggaaagcacctctccggcgttccgtgaagccaacatccagggtaaaaacctgatcgactggctgccgggctccacgctgtgggcgggtaaacgcttctatcagcgtcatgacgttcacatgatcgacttctactactgggatatctccggcccgggtgcaggtctggaaaacgttgaccttggcttcggtaagctctctctggccgctacccgtaactcagaaagcggcggctcttatactttctccagcgatgacaccaaaaaatatgctgcgaaaactgccaacgacgtctttgatatccgtctggcgggtctggaaaccaacccgggcggcgtgctggagttaggggtcgattacggccgtgctaacccgcaggatgactatcgcctggaagacggcgcgtcgaaagacggctggatgtggaccggtgaacatactcagtctatctggggcggcttcaacaagtttgtggttcagtacgccactgacgcaatgacctcctggaacagcggccactctcaggggaccagcatcgataacaacggcagcatgatccgcgttctggatcacggcgcgatggacttcaacgatgactggggcctgatgtacgtggcaatgtaccaggacgtggatctggacagcaagaacggttctacctggtacaccgtgggtgtccgtccgatgtacaaatggacgccgatcatgagcacccagctggaaatcggttacgacaacgtgaaatcccagcgtaccagcgaaaacaacaaccagtacaaaattactctggctcaacagtggcaggcaggcaacagcgtctggtctcgtccggctatccgtatcttcgcaacctacgcgaagtgggatgaaaactggggctacagcaacacctccggtctgcagacgaaagacagcagcggaagcggcgctttcacctccagccgcggtgacgacagcgaagttaccttcggtgcccagatggaagtgtggtgg

SEQ ID NO: 16 - DNA, 1896 bp, Klebsiella pneumoniae
atggctatcgaaatcaaagtaccggacatcggggctgatgaagttgaaatcaccgagatcctggtcaaagttggcgacaaagtagaagctgaacagtcgctgatcaccgtagaaggcgacaaagcctctatggaagtcccgtctccgcaggctggcgtcgtgaaagagattaaagtctccgtcggcgacaaaaccgagactggcaaactgattatgattttcgattccgccgaaggtgcagccgccgctgcacctgcgcaggaagagaagaaagaagccgctccggccgccgctgctccagcggctgccgcggcagcgaaagaagttcacgtcccggatatcggcggcgatgaagtcgaagtcaccgagatcatggttaaagtgggcgacaccatcgccgctgagcaatccctgatcaccgtagaaggtgataaagcctctatggaagttccggcgccgttcgccggtaccgtcaaagagatcaaaatcaataccggcgataaagtttccaccggctccctgattatgatcttcgaagtggcgggcgctgcgcctgcagccgctccggcacaggctgccgcgccggctgctgcggctccggctgccgcagcaggcgtgaaagatgttaacgtcccggacatcggcggcgacgaagttgaagtcaccgaagtgatggttaaagtcggcgataaagtcgcggcggaacagtccctgatcaccgtagagggcgacaaagcctctatggaagttccggcgccgttcgcgggtaccgttaaagagatcaaaatcagcaccggcgataaagtcaaaaccggttccctgatcatggtcttcgaagtggaaggcgctgcgcctgccgccgctccggctcaggctgctgcaccggcaccagctgctgccccggctcaggccgctaagcctgccgctgcgccggctgcgaaagcagaaggtaaaagcgaattcgctgaaaacgatgcctacgttcacgcgaccccgctgattcgccgcctggcgcgcgagttcggtgttaacctggcgaaagtgaaaggcaccggccgtaaaggtcgtatcctgcgcgaagacgttcaggcttacgtgaaagaagcggttaaacgcgctgaatccgcaccggctgctgccgcaggcggcggtatcccgggcatgctgccgtggccgaaggttgacttcagcaagtttggcgaagtcgaagaagtggagctgggtcgtatccagaaaatctctggcgccaacctgagccgtaactgggtgatgattccgcacgttacccacttcgacaaaaccgatatcaccgatctggaagcgttccgcaagcagcagaatgccgaagctgagaagcgtaaactggacgtgaaattcactccagtggtcttcatcatgaaagcggttgccgctgcgcttgagcagatgccgcgcttcaacagctcgctctccgaagatggtcagcgcctgacgctgaagaaatacatcaacatcggtgtggcggtggataccccgaacggtctggtggttccggtcttcaaagacgtgaacaagaagagcatcaccgagctgtctcgtgaattgaccaccatctcgaagaaagcgcgcgatggcaaactgacggctggcgaaatgcagggcggttgcttcaccatctccagcatcggcggcctgggtaccacccacttcgcgccgattgttaacgcgccggaagtggccatcctcggcgtgtctaagtccgcgatggagccggtatggaatggtaaagagtttgtgccgcgcctgatgctgccaatctctctgtccttcgaccaccgcgtcatcgacggtgctgatggtgcccgcttcattaccatcattaacaacaccctgagcgacattcgccgcctggtgatg

SEQ ID NO: 17 - DNA, 771 bp, Klebsiella pneumoniae
atggatcgtattattgaaaaattagatcgcggctggtgggttgtcagtcacgaacaaaaattatggttgcctggtggagaattaccacatggcgaagcggttaatttcgatcttgtcggccagcatgcgctgcatattggcgagtggcagggcgagtccgtgtggatggtgcgccaggatcgtcgccatgacatgggatcgttgcgccaggtgctggatcaggatccgggactcttccagctggctgggcgggggatccagctcgccgaattttatcgctcgcataaattttgcggttactgcggccacccgatgcatgccagcaaaagcgaatgggcgatgctgtgcagccactgccgtgaacgttactacccgcaaattgccccctgcattatcgtggcaatccgtcgcgacgatgcgatcctgctggcgcaacatacgcgccatcgcaacggcgtgcacaccgtgctggccggctttgtcgaggtcggcgaaacccttgagcaggcggtggctcgcgaggtgatggaggagagcggtattcgggtaaaaaatctgcgttacgtgacctctcagccatggccgttcccgcagtcgctgatgaccgcctttatggcggattacgcagatggcgagatcgtggtcgacaaaaaagagttactgaccgcggactggtatcgctatgacgacctgccgcttctgccgccgccggggacagtggcgcggcggcttatcgaagataccgtcgcgatgtgtcgggcagagttcgag

SEQ ID NO: 18 - DNA, 390 bp, Klebsiella pneumoniae
atgttttcatacattatgctgggaacgaacgatctgccacgcgccatcaagttctatgacccgttaatggcgctgctgggacacgtcaaagccggccgtaacgaacagggggcgtcctggggcaccttcaacggcaatcacacctgcgggctgtgcgtgggtgttccttttgaccagcagcctgccggggtgggtaatggaacgatggtggcgcttaacgcccgctccgtcgcacatattgcggaactgcatgccctcgccctgcaactcggcggacgtgacgaaggcggtcccggtcaccggccgcagtatggcgacggttttcacagcgcctacgtccgcgatcccgacggcaataagctggcgtttgtttactatgcgtcggcagat

SEQ ID NO: 19 - DNA, 1761 bp, Klebsiella pneumoniae
atgaacgtattacgcagaaagtggcaggggctgccgcgcggcgtggtggtgtgcatcacggcgctggtgatttatgtcccgctgttatttattgtggtgcagagttttctttcggcaccgttcttttcccgctccaaatcgtggagtctggaagccttcgcctttatttttaccgacccggatttttatctggcattaaggtcaggttttattctggcctttggcctggtgattatcgccattccgctgggcggtattttggcctttctgatggtgcgcaccgatttacccggccggcggatcattgagccgctgatcctggtgccgatcttcgtctcgccgatggtgctgggctttggctacgtggtggccgccgggccggtaggcttcttttcccagtgggcgcagcagctgatcggctttgtgccgtggaatatctactcgatgttcagcattgtggtcatcgccggcttaactcacgttccgcatgcctatctctatatctcttcggcgctgcgcagcgtcggctccgacgtggaagaggcggcgcgcaccgtcggcgccacgccgctgcaggtgatgacctcggtgagtctgccgatggtgcggccatccattctttacgcctgcgtgttgctctttttcctcggtctggaagtcttcggtctgatgctggtgctgggcgaccccgagggcaacatggtgctggcgacctatctctacaagctgactaacaagctcggcaccccctcctaccatctgatggcggcggtggcggtggtgctgatctgcatcaccatcccgctggtgatgctccagcggcggctgatgcgcaccgccaaccgctttgtcaccatgaagggcaaggcgtcccaggcgcgggcgctgccgctgggcaaatggcgctgggtggccggggcggtggtggtggcctggctgacggtgaccatcggcgtaccgctgctcggcgtggcgctgcgcgcttttatctccaactggggcgtcggcgtgtcgctgtgggatgagctgtcgctggcgacgttccacaatatctggcagcagcccaacctgctgcgggcgatcgtcaactcgatggctatcggcatcatcggcggcgcgctggcggtgatctgctatctgtttgtcggcatcgccatgcaccgcaaagcggacaacgtcacccgctttctcgactacagcgtgctggtcccgcgcgcggtaccggggctgctggccggcctggccttcctgtgggtattcctgtttgtaccgatgtggctcgatcagtcgctgaagcacggctggctctcggcgctgcggtggccgactggctgcgggagcaccttatcgtgcagctgcgccctgcgcaacaccatcttcagcgtctggctggcctacaccgtggtgtggatggctacgctgcggctcatctcctcgacgctgctgcaggtgggcccggagctggaggaggcggcgcgtagcaccggcgcctcgcgggggcagatcacccgccacgtgaccgttccgctgtcgcgctatgggctgattggctcctggctgctgatgttcctgatctttgagcgcgagtattccactggcgtctatctgctgtcgccgggtaccgaaaccatcggctcgatgctggtgtcgctgtgggcggcgggggccatcgatatcgtcgcggcgctctcctttatcaatattctgctggtggtgattggccttggtatcgccctgcgctttggagtgaaattacatgat

SEQ ID NO: 20 - DNA, 903 bp, Klebsiella pneumoniae
atgcaggatctcaatgacttcgcctggtttgtccaggtggtagaccatggcggtttcgccgcggcggggcgagcgcttgaccagccgaaatccaaactcagccgccgcattgcgcaactcgaggagcggttgggcgtgcgtttgattcagcgaaccacccgtcagttcgcggtcaccgaggtcgggcagaccttttatcagcattgcaaagcgatgctgattgaggccgaggcggcgcagcaggcggtcgagacgctgcgcgccgagccgcgcggtagcgtcaggatcacctgtccggtcaccttgctgcatgtccatatcggaccgatgctggcgcgatttatggcgcgctatcctggggtaacgctgcatcttgaggcgaccaaccgccgggtggatgtggtcggggagggcattgatgtggcgatccgcgtccgtccccggcccatcgaggatagcgacctggtgatgcgcgtgctggcggaccgcgggcaccggctggtggccagcccggatctcatttcccggctcggacgtccgcaggcgccgtccgagctgagcgcctggccgggcctcagcctgggtgcgaacaagcatcagcataaatggcagctcaccgggcccgggggagcgagagcggaagtgtatttcacgccgcgaatggtgaccaccgatatgctggcgctgcgcgaggcggcgatggccggcgtaggcgtggtgcagcttcctttattaatggtgcgcgatcagctggcgtcaggtgaattagaggtggttctggacgagtggcagccgcggcgggaagtgatccatgcggtatttgcctcacggcgcgggctgctgccctccgtcagggcgctggtggactacctcagtgaagagtatcagcggatggaggaagat

SEQ ID NO: 21 - DNA, 1143 bp, Klebsiella pneumoniae
atgagtggcgctaatgcgtccggctatttagaatcgcgcaccatgaaaactgagaccccaaccgtaaaaatggttgccattgctgctgatgaagcggggcaacgtatcgacaactttttgcgtacgcaattgaaaggcgtaccgaagagcatgatttatcgcatcctgcgtaaaggcgaggtgcgggtaaacaaaaagcgcgtgaagccggagtataagctggaagcgggcgatgaagtccgtatcccgccggtacgcgtggcggagcgtgaagaagaggcggtatcgccgcacctgcagaaagtggccgcgctctctgaggtgatcctctatgaagacgatcatattctggtgctcaataagccttctggtactgcggtacacggcggcagcggcctgagcttcggcgtgattgaagggctgcgcgccctgcgcccggaggcgcgcttccttgagctggtgcatcgtctcgaccgggatacctccggcgtgctgctggtggcgaaaaagcgctcagcgctgcgttcgctgcacgagcaactgcgcgataaaggcatgcagaaagattatctggcgctggtgcgcggccagtggcagtcgcataccaaagtggtccaggccccgctgttgaagaatattctgcagagcggggagcgcatcgttcgcgtgagtcaggaaggcaagccgtcggagacgcgctttaaagtggaagagcgttacgaattcgccacgctggtgcgctgcagcccggtcaccggccgcacgcatcagatccgcgttcatacgcagtatgccggccatcctatcgcttttgacgaccgctatggcgaccgcgagttcgacaagcagctgtccgctaccggcttaaaccgcctgttcctgcacgcggcggcgctgaagtttacccacccggggagcggggaggtgatgcgcgttgaggcgcccgctggacaaccagctgaagcactgtttacaggtgctacggaagagcaaataagcgcaacgcggaatcagttccgccgttttttttgcctcagcctaacagcgggttgtagttttcacggcgcaacatctgacagagcgcgattaagggtaaaccgaccagggtgttcgggtcgcggccttccagccgttcgaacagcg

SEQ ID NO: 22 - DNA, 2526 bp, Klebsiella pneumoniae
atgaataagataacaaagtacattgacgcattgccgctgtcggacgccgagaaatcggcgctgccggacaccagcctgcaggccgttcatcaggccctggatgacgaccatcagaccttcgcccgcgaagacgactccccgctggggtcggtcaaggcacggctggcgcatagctggccggattcgctgtctggcgatcagctggtgaaggatgatgaaggccgtactcagctgcatgcgatgcctaaagccaagcgctcctcaatgatcccggacccgtggcgtaccaacccggtcggccgcttctgggaccgtctgcgcggacgcgatgtcacgccgcgctatctctcccgtctgacgcaagaagagcgcgagagtgagcaaaaatggcgtaccgtcggcaccattcgtcgctatatcctgctgctgctgacgctgtcgcagaccgtagtggccacctggtatatgaaaaccattctgccttatcagggctgggcgctgatcaacccggccgacatggtggggcagaacctgtggatctcgttcatgcagcttctgccgtacgtgttgcagagcggcattctgatcctcttcgcggtgctgttctgctgggtttccgccggcttctggaccgcgttaatgggcttcctgcagctattgatcggccgcgataagtacagtatttccgcctcgacggtcggtgacgaaccgttgaacccggcgcaccgtacggcgctgataatgccgatctgtaacgaagacgttgaccgcgttttcgccggcctgcgggcgacctgggagtcggtgaaagcgaccggtaacgccgctcatttcgacgtctatatcctcagcgatagctataaccccgatatctgtgtggctgagcaaaaggcgtggatggagctgattgccgaagtgcagggcgaagggcagatcttctaccgccgccgtcgtcgtcgagtgaagcgtaagagcggcaacatcgatgacttctgccgccgctggggcagccagtatagctatatggtggtgctggacgctgactcggtgatgaccggtgagtgtctgagcagcctggtgcgcctgatggaagcgaacccgaatgccgggatcattcagtcttccccgcgcgcctcgggcatggacacgctgtatgcgcgttgccagcagtttgccacccgggtgtacggtccgctgtttacggcgggtctgcacttctggcagttgggggagtcccactactggggccacaacgccataatccgcgtgaagccgttcattgagcactgcgcgctggcgccgctgccgggcgagggcaactttgccgggtcgatcctgtcgcacgacttcgtcgaagccgcgctgatgcgccgtgccggctggggggtgtggattgcctacgatctgccgggctcctatgaggagctgccgccgaacctgctggacgagctgaaacgcgaccgtcgctggtgtcagggcaacctgatgaacttccgcctgttcctagtcagagggatgcacccggttcaccgggcggtgttccttaccggcgtgatgtcctacctgtcggcgccgctgtggtttatgttccttgccctgtcgacggcgttgcaggtggtgcatgccctgaccgagccgcagtacttcctgcagccgcgtcagctgttcccggtgtggccgcagtggcggcctgagctggccatcgcgctgttcgcctcgaccatggtgctgctgttcctgccgaagctgctgagtattattctggtgtggtgtaaagggccgaaagagtacggcggatttttccgcgtcacgctttcactgctgctggaggtcctgttctcggtcctgctggcgccggtccgtatgctgttccacaccgtcttcgtggtcagcgccttcctcggctgggaggtggtatggaattcgccgcagcgtgatgatgactccacgccgtggggggaagcctttatgcgccacggctcgcagctgctgctggggctggtgtgggcggtcgggatggcatggctggatctgcgcttcctgttctggctagcgccgattgttgtctcgctgatcctctcgccgttcgtgtcggcgatttccagccgggcgacagtgggcctgcgcaccaagcgctggaagctgttcctgatcccggaagagtattcgccgccgcaggtgctcaaggataccgatgcgtacctgacgatgaaccgtcagcgttcgctggacgatggctttatgcacgcggtgtttaatccgtcgtttaacgccctcgccaccgcaatggccactgcgcgccaccgtcagggtcatatcctggagatcgcccgcgagcgccatgtcgagcaggcgctgaatgaaacgccggataagctgaaccgcgatcgccgactggtgctgttgagcgacccggtaaccatgtcgcgtctgcactatcgcgtatgggccgcgccggagaaatactcttcatgggtgaacgcctatcagcagttggcgcttaacccgctggcgctgaaaacgaaa

SEQ ID NO: 23 - DNA, 600 bp, Klebsiella pneumoniae
atggaaatggctaaaattctggtgctttattattccatgtatggacacattgaaaccatggctcacgccgtcgccgatggggcgaaccgggtggacggcgttgaggtggttgtgaagcgcgtgccggaaaccatgcaggctgaagcattcgccaaagcaggcgggaaagcgcaaaacgcgcccgtcgccacgccgcaggagctggcagagtatgacgccatcatctttggtaccccgacgcgcttcggcaacatgtccggtcagatgcgtactttcctcgatcaaaccggcggtctgtgggcgtccggcgctctgtatggcaaaatcgccagcgtatttagctcaaccggtaccggcggcggccaggaacaaaccattacctcgacctggacgacgctggcccaccacggcatgatcatcgtcccgatcggctatggcgcccaggagctattcgatatttcccaggtacgcggcggtaccccttatggcgcaaccaccatcgccggcggcgacggctcgcggcagccgagcgaggaagagttagccatcgcccgctatcagggtgaacatgtcgccaaactggccgttaaactgcacggc

SEQ ID NO: 24 - DNA, 2319 bp, Klebsiella pneumoniae
gtggagcagcatgcaggcgactttagcgtcaccgtacgcgatgtgcgtcagctgacccagccggaaagcgatctgctgacgctgctgtgggtgctggagggaagcgtaaatctggcggtggcggaaggtgcgtcgcagccgctcgccgccgacgggctggcgatcgttaaccgcaaccgtcgctggagcctgcgcagcgccggggccaacgccgtgatgatcctcaccctctccgccaactggctggcccgcctcgataatgccttttttgccgtcgattaccagataacgccgcgcacccgggatgccgatgacggcctgcgccgcctgatgcgccagctgctggtgagcggcctggtcaatcatcctggccattaccgactggaggccaaccgctggctgagtgagatagcgctgctgctggccacgcgctttagccagcccatcgcctccacgccccggcgcgataccgaaaaatggagccggagaatagccagcgtggtggcgcggatcgacgctaactatcagcgtcgcctctcgttgcatgaggtggcggccgcggaatttgtctccgaggcctggctgtcacgcttatttcgcaaagaggtcggggtaagttttgtccagtacctcaccgcgctgcgcctgcgccacgccgccgaccagctattaaccacccgcaaaaccgtccagcaaatcgcccgcgaacagggattcgccagtacgcgaatgatgagcgatttgtttaagcgccagcacggcgtgacgccgcgccagtatcgtgaacagcatcctctggagcttgcccgaccgcgcccgccgcaggccgatcgctggcagccggtggcggccgaccggctgtatgcgcgactcaatgagccggaaccacgcgaccgggaaagtccccccctgccgatcaacccaccgcagacccgggagatcaatctgcgcgatcgtccagcgcgccccgcagcgctgcgccatacccggatggtggtgaccgtgcgcgaactggacgatctgctgcgtgaagatgtgcgccgggaactcgaacagctgcaccacgccctgccggtgtatgccatcgatatcaacgatccctttctcagcagtcggctgttcggcaccggctgggacgatccgcagatggccggctacgcctgctggtacaacctgcagcagatttttagctggctggcggcgatgggctggcaggtgatcctgcacaccggcgtcaccacccgcagtgacctgctgcagcgcttcctgcagctcgccgccaaccattttccgccagccacgctcaacagctggcgctttgtctggcactggtcgccgcaggccagcgaagctgcgcgccaggccgcctggcggcagcagcgcggggtccttcatcgcctgctgccgcagccgcagctggggatctggcaccgctttgctcccagcgatcccgggaacgatccgctgttccactcgccgctgctggcagaggcggattttctcgcctgccaggcagatgccaacgaacagctggatctggcccaggcagacagcagccgcctggcctccagcgaacattacccgctgcacaagctgcggcagatccacagcgccctgcgccagcgtcagctcaacctgccgctgtggctgctctcctggaatacgctgaccggcgatacgcgggataccaacggccgcttttttcgcggcgcgctgctgatggataatctgctgggggtggcggaccaggtctggctggcgggcttctggttaaattcaggcctccagggcgaagctcgcgccaacggcaagctcgatacctccagcctggcgctgcactatctgcacggcctgccgcgcccggtttactgggtactctggctctggcggcggctgcgcggcgagatcctggttcacgataaaaacctgctgctgctccaccaccagggtcactatcagctgctgctgcgcaatacggtggtctacaatccctggctctccagcgaagcggcctttatccagcgcttcagccagctctacagcgtgcggctgcagggcctggatggcagctggcgcatcaaacagcacctgttcgatcagcaccacggcgcgttgttcccgctggtggacgcctttcgcagccgcagcggccctgacgccgaggattatcagtggctgatgcatcaggcccgtccggcgctcagcgtggatgaagccaggctcgatggctattggctgcggatcgactcgctgcagagcaatgcgctggtgctgtatgaatttacccctcagctctcctccggcgcggatcccgccccc

SEQ ID NO: 25 - DNA, 945 bp, Klebsiella pneumoniae
atgaaagcagccgtggtttttgatctcgcagaaggcccggtttgggccgaatttatcgacccgcagcccgcgcccggccagacgctcattgacgtccgcgccgccgcgataagccatgtggttaaggcccgggcatccggacgccattacagcttcgacggcaatctgccctttgtgcctggtatcgatggcgtcggcaccacacctcagggccagcgcgtctacttcgccttccccaccgcccccttcggcagtatggcgcagcgggcgccggtcgccctgcagaattgtctgccgctgccggatgcgctcgatgatatccaggcggcggcaatggccaaccccggtatgtccgcgtgggcatcgctggtgacacgcgcccagcttcaggccggcgaaacggtgctgattaatggcgccaccggcagcgccggtcagttggcggtacagattgcccgctatctgggggcgaaaaaaatcattgcaaccgggcgcaatgcgcagtcgctcgcggcgctggacgccgatgagtgtattcagttaaccgctgatgataaaaccttgagcgggcaattttcagcggtcagcgccgcgcagatcgatgtggtcatcgattacctgtggggacacagcgcggaattattattgccggcactggcgaaatatacccctgccggcagtccggtgcgctatgtgcaggtgggttccctggctggcgccgatatcgcgttaaatggcgcagtgctgcgttccgccccgctcctgctgatgggcagcgggatcggtagcctgtcggtatcgcagctgctggcggcgaccggcgaaatgctgcaggcggcggtgccggggaaattgaccatcgccaccaccccgcggccgctgcaggagatcgcggcggcctggccacaggacgacagccagaagcgcacggttttcaccctcgga

SEQ ID NO: 26 - DNA, 1446 bp, Klebsiella pneumoniae
gtggatctctccattattatcagcgcggttatcgcactggcagccgggttaatggtcggctggctggcgaccaaagcgcgcgccgatcaaattcgggccgatctcatcgaggaacggcgagagttggatattgagctgagcgccgcccgccagcaactggcgcaggaggcccactggcgtgaggagtgtgagctgctgaacaacgagctgcgcagcctgcgggatatcaatacctcgctcgaggccgatctccgtgaggtcaccacccggctcgaatccacccagctgcatgcggaagataagatccgccagatgatgaacagcgagcagcgccttagcgagcagtttgaaaacctcgccaaccgtattttcgaacacagcaaccggcgggtcgatgagcaaaaccgccagagcctgcatggcctgctgacgccgctacgcgaacagctggacgggttccgccgccaggtgcaggagagctttggccaggaggcgcgtgaaagacataccctggcgcatgagatccgcaatctgcagcagttgaacgcgcagatggcacaggaggcgctgaacctgaccaaagcgctgaagggggataacaaaactcagggcaactggggggaagtggtcttaacccgcgtgctggaggcctccggcctgcgcgaaggctatgagtaccagactcaggtcagtattgagaccgacaaccgctcgcggatgcagccggacgttatcgtgcgcctgccgcagggtaaggacgtggtgatcgacgccaaaatgaccctggtcgcctatgagcgctatttcaacgccgaagacgactacacccgcgaagtcgcgctgcaggaacaccttgcctcggtgcgaaaccatattcgcctgctgggacgcaaggattatcaacagctgcctggcctgcgctcgctcgactatgtgctgatgtttattcccgttgagccggcgttcctgctggccatcgatcgccagcctgagctcatcagcgaggcgctgcaaaataatattatgctggttagcccgacgacgctgctggtagccctgcgcactatcgccaatctgtggcgctatgagcaccagagtcgtaacgcgcagaagattgccgagcgggcggggcgcctttacgacaaaatgcgcctgtttgtggatgatatgtccgccatcggccagagcctggataaggcgcaagagagctatcgccaggcgatgaaaaagctcgcttccgggcgtggtaatctgctggcccaggcggaggcctttcgcggcctgggcgtggaggtcaagcgcgggattaatcctgatttagtcgaacaagctacggctcaggacgagcaatatcgtctcgaagatgaggataacctgccggaaaatgacgcattttcagccgactctgccgagacggtgcgtagccgggaggcggctccgccacgc

SEQ ID NO: 27 - DNA, 1194 bp, Klebsiella pneumoniae
atgttgaatgtggaaatgctgtccaccggcgatgaagtgttgcatggtcaaatcattgataccaatgcggcatggctggcggatttcttttttaatcagggtttaccgttaacgcgccgcaataccgttggcgacgatctcgatgcgctggtggcgattctgcgcgaacgcagcgaacaggcggatgtgctgatcgtcaacggcggcctcggcccaaccagcgacgacctgagcgcgctggccgccgccactgcgaaaggcgaggggcttattttgcatccggagtggctggaaaccatgacccgcttttttgccgagcgcggcaggccgatggcggaaagcaaccgtaagcaggcggaaatcccggccagcgccgagatgatcaacaacccggtcggtacggcctgtggctttgccatccagctcaaccgctgcctgatgtttttcactcccggggtcccctctgaatttaaggtgatggtcgagcaggaaattttaccgcgcctgcgccagcgctttacgctgccggacccgccggtatgcctgcgtttgaccacctttggccgctcggagagcgagctggcgcaaagtcttaatccgctgacgctgcctccgggcgtggtgatgggttaccgctcgtcgatgccgatcattgaactcaagctaaccggaccggccaaccagcgcgacgccatgctggccctgtggccggaggtgcgtaaggtggctggcgacagcctgattttcgaaggtacggaagggttacccgcgcaaatcgcccgctgtctgcaggagcggcagctgagcctgacgctcagcgagcagtttaccagcggcctgctggcgctccagctgtcccgcgccggcgcgccgctgctggccagcgaagtcgttccggcgcaggaggagacgctggcgcaggcggcccgctgggcggccgagcggcgcataaaccattttgccggcctggccctggcggtgagcggtcaggaaaacgatcatcttaacgtggccctggccaccccggacggcaccttcgcgctgcgggtgaagtttagcgccacccgccacagcctggcggtacgccaggaagtctgcgctatgatggcgttaaacatgctgcgtcgctggctgaatggtcaaccactggccagcgaacatggctggattaacgtggtggattccctctcgctg

SEQ ID NO: 28 - DNA, 945 bp, Klebsiella pneumoniae
atgattgaatttcaaggggtcagcaaagtgtttgccggccacccggcggtgaaggacctgaccctggagctgcgcgaaggcgctttctcggtgctggtggggacttccggctcgggcaagtcgacgacgctgaagatgatcaaccgtctgctggagccggaccggggcaccattcgctttgccggcgaggacattcgccagcagccggtcctgaccctgcggcggcggatgggctatgccatccagtccatcggcctgtttccccactggacggtggcgcagaatatcgccaccgtgccgcagttgcaaagatggccgcgggcaaggatcgccgaccggatcgacgagctgatggcgctgctggggctggaggcgacgctgcgcgaccgttacccgcatcagctctccggcggccagcagcagcgggtgggggtggcgcgggcgctggcggcagatccggaggtgctgttgatggatgagcccttcggcgccctcgacccggtgacccgcgaggcgctgcagcaggagatgctgcgcattcaccgtctgctgggacggacgattgtgctggtgacccatgatattgacgaagcgctgcgtctggcggaccacctggtgctgatggacgggggcgaggtggtccagcagggggcgccgctggagatgctcctgcgaccgaaaaatagctttgtacagaccttttttggtcgcagcgagctgggtgtgcgcctgctgtcgctgcgcgaggtgggggactatttgcgtcccgacgaacggctggcgggcgaggggctgaccgtcaccatgaccctgcgggaagcgctgtcgcagtttgtcgcccggcgctgcgagacgctgccggtggtcgatgccgaaggcaggccctgcggtacgctgcattttgccgatctgctgcgccaggagatgagccatgaaggcgcttcg

SEQ ID NO: 29 - DNA, 1068 bp, Klebsiella pneumoniae
atgaaaatgaaacttaccgcgctgatgagcggaatgattctgtccagttcggcgctgtgcttcagcgcgacagcggctgataaaatggtcatcgcccaccgcggcgccagcgggtatctgccggaacataccctgccggcgaaagcgatggcttacgctcagggggcggattaccttgagcaagacctggtgatgaccaaagacgaccggctggtggtgttacacgaccactatctcgatcgggtgactgacgttgcgcagcgtttcccgcagcgggcgcgtaaagatggccgtttctacgccatcgactttaccctggacgagattaagtcgctgaagttcaccgaaggttttgagccgaaaaatggtaagaacgtgcaaacctatcccgggcgattcccgatgggcaaatccgatttccgtattcatacctttgaagaggagattgagtttgtccaggggctgaaccattcaaccggcaaaaacatcggtatctacccggaaatcaaagcgccgtggttccaccaccaggaaggcaaagatattgccgccagcacattgaaggtgctgaaggaatatggctataccagcaagcaggataaggtttatctgcagtgctttgacgccaacgagctcaaacgcattaaaaatgagctggagccgaagatggggatggatctcaatctggtgcagctcatcgcctataccgactggaatgaaacccagcagaaacaggccgatggtaagtgggtgaactacagctatgactggatgttcaagccaggggcgatggcgcagattgcgcagtacgcggacggtatcggcccggattaccatatgctggtagcggaaggctcgaagccgggggcggtgaagctgacggcgatggtgaaagaggcgcatgccagccatctgcaggtgcatccgtacaccgtgcgcgcggatcagttgccggagtacgcgactaacgttaatcagctctatgacgtgctgtataaccaggcgggcgtcgacggcttatttaccgatttcccggataaagcggtgcagttcctggacgcgaaacgc

SEQ ID NO: 30 - DNA, 1059 bp, Klebsiella pneumoniae
atgcgaccaacaatgatgacatatatcagtgaagagccggcctgcctggcgcagatcctgcgcgactaccggcaaaagctggcgccgattgaaaccttcgtccgccagcacccggtacggcgaatattattgctcgcgaccggatcgtcgctgaatgccgcgctgtgcgcgcgctatttctttgagcaacgcttcggtgtgctgcttgacattaaagagccgtacaacttcacccattacgacgcgatcgacccgcatgccgatctggtggtggcgatttcacagagcggaaaaagcgcgtcgacgctggaggcgatgcgtaaggtacaggcttccggcaagtcggttttcgccctgacctcagatccgcaaagcccgataggaggcgccagcgatggcgttctggatattaataccgggatcgagagcgtagggtttgtgacccgcggctttagcgcgacggtgctcaacctgttgctgatagcgctgatcattgctcgtaagcaggagaaagccagcgaggtcgaggagcagcactatctcgctgaattgcagcggctggtagcggcgatcccggaggttatcgtccgcacctcgcgctttattgaccgccatagcgaaacgctgcgcagcggcgagcgctttgtcgccaccggctacggcgcgctggttggcgtggcgaaggagttcgaaaccaaatttaccgagacggtgcgcgtgccttccagcggctttgagctggaagcctatatgcatggcccctatctggaagccaatgcccgccatgtgatgctgtttattgaagatacgccggacgcgcgaacccgggcgctgcgcgactatctggcgccgtccattggccgggcctttaccctgacgctgggtgacgaagaggatgctcaaacgctggcgctaaactgtccgtgcgagcatcacctggcgcctctgctgctgattgtcccagtgcagatgctcgcctggcataccgcaggactgaaaggcatcgatctggctaaacgtattttcgacgattttgaccgcgtcttaaaaagtaaaatc

SEQ ID NO: 31 - DNA, 2814 bp, Klebsiella pneumoniae
atgagtgactataaatcgaccctgaatttgccggaaacagggttccctatgcgtggcgacctcgccaaacgcgaaccgggaatgctggcgcgttggaccgatgatgacctgtacggcatcattcgtgcagccaaaaaaggcaaaaaaaccttcattctgcatgatggccctccttatgcgaatggcagcattcatattggtcactcggtaaacaagattctgaaagacattatcgttaagtccaaaggactgacgggctatgactcgccttacgttccgggctgggactgccacggtctgccgatcgagctgaaagtggagcaggaatacggcaagccgggtgagaaatttaccgctgccgaattccgcgctaagtgccgcgaatatgccgccgagcagatcgatggccagcgtaaagactttatccgtctcggcgtgctgggcgactggtcgcatccgtacctgaccatggacttcaaaaccgaagccaacatcatccgcgcgctgggcaaaatcatcggtaatggccacctgcataaaggcgccaaaccggtgcactggtgcgtagactgccgttccgcgctggcggaagcggaagtggagtattacgacaaaacctctccgtctatcgatgtcgcgttccacgcggtagacaaagccgcggtactggcgaaattcggcgtagccgacgtcaacggtccggtgtcgctggttatctggaccaccacgccgtggaccctgccggccaaccgcgctatctctctgtctcctgagttcgactatgcgctggtgcaggttgacggccaggcgctgatcctggcgaaagacctggttgagagcgtaatgaagcgcgttggcgcgacggactacactattctggcggcggtacaaggttctgagcttgagctgatgcgctttaagcatccgttcctcgatttcgacgtgccggcgatccttggcgaccacgtgacgctggatgccggtaccggtgcggtgcataccgctggcggccacggtccggacgactacaccatcagccagaaatacggtctggaaatcgccaacccggttggcccggacggcgcttacctgcctggcacctggccgtccctggacggcattaatgttttcaaagccaatgacatcatcgttgagatgctgcgtgagcgtggcgcgctgttacacgttgagaaactgcagcacagctatccatgctgctggcgccacaagtcgccgatcatcttccgcgccactccgcagtggttcgtgagcatggatcagaaaggcctgcgcgcgcagtcgctgaaagagatcaaaggcgtgcagtggatcccggactggggccaggcgcgtatcgaatcgatggtcgctaaccgccctgactggtgtatctcccgtcagcgcacctggggcgtgccgatgtcgctgttcgtgcataaagaaacccatgaactgcacccgcgtacccttgagctgatggaagaagtggcaaaacgcgttgaagttgacggcatccaggcgtggtgggatctcgattcccgcgacattcttggcgatgacgccgacagctatgagaaagtgccggataccctcgacgtctggtttgactccgggtcgacccactcttccgtggttgacgtgcgtccggaattcgccggtcacgccgccgatatgtatctggaaggttctgaccagcatcgcggctggttcatgtcctcgctgatgatttccacggcgatgaaaggcaaagcgccatatcgtcaggtactgacccacggcttcaccgtcgacggtcagggccgcaaaatgtccaagtctatcggcaacaccgttagcccgcaggacgtgatgaacaagctcggcgccgatatcctgcgcctgtgggtggcttccaccgactacaccggcgaaatggcggtctctgacgagatcctcaaacgcgccgccgacagctatcgtcgtatccgtaataccgcgcgcttcctgctggcgaaccttaacggtttcgatccggtgaaagacatggttaaaccggaagagatggtggtgctggaccgctgggcggtcggctgcgcgcaggcggcacaggaagatatcctgaaagcctacgaatcctacgacttccatgaagtggtgcagcgcctgatgcgcttctgctccatcgagatgggctcgttctacctcgacatcatcaaagaccgccagtacaccgccaaggcggacagcgtggcgcgtcgcagctgccagaccgcgctgttccatatcgtggaagcgctggtgcgctggatggcgccgatcatgtccttcaccgcagatgaaatctggggctatctgccgggcgagcgtgagaaatatgtcttcaccggcgagtggtatgaaggtctgttcggcctggccgacgacgaagcgatgaacgacgatttctgggatgagctgctgaaggtgcgtggcgaagtcaacaaggtgatcgagcaggcgcgtgcggataagaaagtcggcggctcgctggaagcggcagtcacgctgtatgctgatgccgatctggcggctaagctcaatgcgctgggcgatgaattgcgatttgtcctgttgacctccggggcgaacgtcgcagactatgcgagcgcgtccgctgatgcgcagcaaagcgaactgcttaaagggctgaaagtcgcattgagtaaagctgaaggtgagaaatgcccgcgctgctggcattacaccaccgatatcggcaaggtggcggaacacgcggaaatctgcggacgctgtgtgagcaacgtcgccggtgacggcgagcaacgtaaattcgcc

SEQ ID NO: 32 - DNA, 1035 bp, Klebsiella pneumoniae
atgacagatcaaccgcaacgccatcgccgctgggtgctggcttcccgtccccatggtgaaccgacggcagagaatttccgcctggaagagagcgaagtgccgacgccaggcccgggtcaagtgctgctgcgtaccgtttatttatcgctcgacccgtatatgcgcgggcgcatgagcgacgcgccgtcctattcgccgccggtggccattggcgcggtgatggtgggagggaccgtgagtcgcgtggtcagctcaaatcatgccgattatcaacccggcgactgggtgctgggctacagcggctggcaggattatgaactctccgacggcagcggactggtgaagctgggtgacaatccgcaacacccgtcctggtcgctgggagttctggggatgcccggcttcaccgcctacatgggtttgctggaaatcggccagccaaaggcgggcgaaacgctggtggtcgccgcggcgaccgggccggttggcgccacggttggacagatcggcaaaattaagggctgccgcaccgtcggcatcgctggcggcgcggaaaaatgccgctatgcggttgagacgttaggctttgatctctgccttgaccatcgtgcggatgattttgccgaacagctggccaaggcctgcccgcagggtattgacgtttattatgaaaacgtcggcggcaaggtttttgacgcggtgctgccgctgttgaataccgcagcgcgggtacccgtctgcgggctggtgagcggctataacgccaccgggctgccggacgggccagatcgtctgccgctgctgatggcgaccatcctcaaaaagcgcatccggatgcagggctttattatcggccaggattacgggcatcggatcgccgaattccagcagcagatggggcgctgggtgcaggaggggaaaattaaatatcgcgaacagctgatcgacggtctggaccaggcaccgcaggcgctgatcggtctgttaaaaggcgagaacttcggtaaggtagtgatccgcgtcgcggcggacgac

SEQ ID NO: 33 - DNA, 2409 bp, Klebsiella pneumoniae
atgaccaaccactgggtggatatcaaaaacgccaacgtcgtggtggtgatgggcggtaacgccgccgaagcccatccggtgggtttccgctgggcgatggaggcgaaaaacaataacgacgccacgctgatcgtcgtcgacccgcgctttacgcgtaccgcgtcggtggccgatatctatgcgccgattcgttccggtaccgacattaccttcctgtcgggcgtgctgctgtacctgatcgaaaacaataagatcaatgccgagtacgttaagcattacaccaatgccagcctgctggtgcgggatgattttgccttcgaagaggggctgttcagcggctacgatgcggaaaaacgccagtacgataaatcgtcctggaactaccagttcgatgaaaacggctacgccaaacgcgatgaaacgctcacccacccgcgctgcgtgtggaatctgctgaagcagcacgtttcccgttacacgcccgaggtggtcgaaaacatctgcggtacgccgaaagcggacttccttaaagtgtgcgacgtgctggcctcaaccagcgccgcggaccgcaccaccaccttcctgtatgccctgggctggacgcagcacaccgtcggcgcgcagaacatccgtaccatggcgatgatccagctgctgctcggcaatatggggatggccggcggcggcgtcaacgccctgcgcggccactcaaatattcaggggctgaccgatttgggcctgctgtcgaccagtctgccgggctatttgacgctgccatcggacaaacagaccgatctgcaaagctacctcagcgccaacacgccgaaggcgaccctgcccgagcaggtgaactactggagcaactacccgaaattcttcgttagcctgatgaaatccttctacggcgaggcggcgcaaaaagagaacgactggggctttgagtggttaccgaagtgggaccaggcttacgacgttatcaaatacttcaatatgatggataacggcaacgtcaccggctatatctgccaggggtttaacccggttgcctccttcccggacaaaaacaaagtggttcgcagcctcagcaagctgaaatatatggtggttatcgacccgctggtgaccgaaacctcgaccttctggcagaaccacggcgagtctaatgatgtcgacccgtcggcgattcagaccgaagtcttccgtctgccgtcgacctgctttgccgaagaggacggttcgatcgccaactccggccgctggctgcagtggcactggaaaggtcaggatgccccaggtgaagcgcgcaatgatggcgaaatccttgccgggatttaccatcgcctgcgcgaactgtaccgcaccgaaggcgggaagggcgcggaacccctgctgaagatgagctggcgctacaagcagccggaccatccggaatcggaagaggtggcaaaagagaacaacggctacgcgctggcggatctctacgatcaaaatggcactttgctggcgaaaaaaggccaactgctcaatagcttcgcgctgctgcgcgatgacggcagcaccgcgtcgtcttgctggatctataccggcagctggaccgagcagggtaaccagatggcgaatcgtgataacgccgatccttcgggcctgggcaatacgctgggatgggcctgggcgtggccgctcaatcgtcgggtgctgtacaaccgcgcttcggccgatatcaacggcaagccctgggatgcgaagcggatgctgatccagtggaacggcaacaagtgggtcgggaatgatattccggacttcaataccgcgccgccagggagcaacaccgggccgtttatcatgcagcaggaggggctgggtcgcctgtttgcgctcgataaactggcggaagggccgttcccggagcactacgagccgatggaaaccccgcttggcactaacccgctgcacccgaaggtggtctccagcccggtggtgcggttgtatgaagaggacgccattcgcttaggtaagaaggataaattcccgtatgtcgggaccacctatcgtctgaccgagcatttccacacctggaccaagcatgcgttgctcaattccatcgcgcagccggaacagtttgtcgaaatcagcgaagggctggcgaaaagcaaaggtatcgctaacggcgattgggtgaaagtcagcagcaagcgcggcttcattcgcgcggttgccgtggtgacccgccgactgcgcacgctgaacgtcaacggccagcaggtggagaccgtcgggatcccgctgcactggggttttgaaggcgtggcccgcaaaggctacatcgccaacaccctgacgcctaacgttggcgattccaactcgcaaacgccggagtacaaggcgttcctggtcaacatcgagaaagcg

SEQ ID NO: 34 - DNA, 1965 bp, Klebsiella pneumoniae
atgcttcccggccgttacgccgttggcttttccagtgattcaggtgatgtaccgctaatgccccttttgagagatgaaattcgcgaccactccgcggaagagatgctgtttatccgccgggccgcaattgcttttctgctggtggtggtctgctttggcgtgctgatcgttaacctctaccatctgcaggtggagcagcacgatttttaccagacccggtcaaaccagaacgacatcaaaatgctgcccatcgcccccagccgcgggctgatattcgatcgcaacggtattccgctggtgcagaatatcaccctgtatcgcctgcaggtgatcccgagcaaaattcccgatatggccgcgctgttgcagcagctgacgcctatcgtcgacctgacgccggacgacatcgccagctttcgcgacgatatgcaccacaccagccgctacaaagcggtcaccctcaagtcagacctcagcgatgtggaggtggcccgcttcgcggtcaacgaattccgtttccccggcgtgacggtggagagctaccaacaacgggaatacccctacggcgcagagctggcgcacgtggtgggctatgtgtcgaaaatcaacgacagcgatctgcagcggctggcgaaaaacggcgaagaggagaactacgccgccgaccgcaatatcggtaagcagggcatcgagggctattatgaaaaagcgctccacggcaccaccggctatcaggaagtggaggtggataaccacggccgggtggtgcgtctactgaaagaggtgccgccggtggccggaaaaaacctctatctgactctcgaccttcatctccagcagtatattgagtcggtgctgaagggacagcgggcggcggtggtggtggtcgacccgcgggatggcggcgtgttggcgatggtctccagtcccagctacgatcctaatccgttcgtcaaaggtatcggctatcaggcctataaatcgctgctggagaatccggaccggccgctgatcaaccgcgtcacccaggggctatatcctccggcttcgacggtcaaaccctatatggcgctgtcggcgctctccgctggggtcatcaccccgaacaccaccttcttcggggcgccgacgtggacgctgccgggcacgcaacgccgctaccgcgactggctgaaaaccggccacggcatgctcaacgtgactaaagccatcgaagagtcagcggacacctttttctatcaggtcgccttcgagatgggcattgaccggatccatgaatggctgagcaagtttggttacggccagtccaccggcatcgaccttaatgaggagtacgccggggtgctgcccagccgggagtggaaacagcgggtgcataaaaagccctggtatcagggggacaccatctcggtcggcatcggccaggggtactggatcgccaccccgatccagatggtgaaggcgcttaccactctgctgaacaatggtaaggtacaggatccgcatctgctctattcgatgaagcagggcaaccatgtggaacgttatcagcagccggcgaacctgccgcaggtgggtgacccgaaatccccgtactggggcattgtgcgcaacggcatgtatgggatggcgaatcagcccaacggcaccggctataagctgtttcatactgcgccgtatcagatcgcggcgaagtccgggacctcgcaggtctttagcctgaagcaaaaccagacctataacgccaaaatgatcccggtgcgtctgcgcgaccatatcttctacaccctgtttgccccttatcagcatccgaaggtggcgatggcgctgattctggagaacggcggcggggatggggtggtggccggaccgacggcgcgcgccatcctggaccatatttttgtcccgcagcaggcatcttcggcggcagccgatgtgccgcagcgtgatagcgccgatgcccag

SEQ ID NO: 35 - DNA, 1116 bp, Klebsiella pneumoniae
atgaatatctgctgcgcaaacgcgaaggcgatagcgggcaaaaattccagcctgaaccttacagagatgccagcaatgaatccggccagtaagaaaaatattcttgtcctggcggccctgggcgctgccgccctggcggcagcgagctacggcgcttactggtggcataccgggcgctttatgcagaccaccgatgatgcctatgtcggcggcgacattagcgccatctccagcaaagtctccggctatatccagcagctggcggtgcaggacaatatggcggtgaaaaaaggtgacctgttgatccgcattgacgaccgcgattatcgcgccgccctcgcgaaagccgccggagaagtggcggcgcagcaggccgcgctggccgatatccaggctacccgccagcttcagcaggcgaccattaccggctctgcggcctcgttactggccgccacggcggcaaccgaaaaactggctaacgacaaccgacgctataacgccctggccgcgtcgagcgcgatttccgcacagatccgcgataacgcctccgccgattatcgccgggcgcacgccgagcaggagaaggccaaagcggataaaaccgtggccgaacgtcagctggcggtgctggatgctcgccagcagcaaatcctggctgccctggcgcaggcccaggctaacctcgagattgccaggctgaacctcagctataccgacattcgcgcaccgttcgatggggtgattggcaaccgccgcgcgtggtccggctccttcgtcagcagcggtacgcagctgctctccctggtacccgcgcacggcctgtggattgacgctaacttcaaggaaaaccagctggcgcatatgcgtgccggccagccggtgaccatcgtcgccgatgtgctgccgaaccatacctttaaggggcatgtcgccagcctggcgccggcgaccggctcacgcttcagcattctgccggcggagaacgcgaccgggaatttcactaaaatcgtgcagcgggtgccggtccgcattgcgctggaaggtgacggggcaaagcttgacgtcctgcgcccgggactgtcggtgatcgtcaccgtgaacgaaaagagccctcga

SEQ ID NO: 36 - DNA, 540 bp, Klebsiella pneumoniae
atgctattaatgcaacgaatcacaaagctggataacgacttaacctgtaagggaatgctgatgaaactctggaataaaacactactcgcttccgccctgtgcctgaccctgtttggctgcgacgatgcgtcgaaagttgataacaaactggataaggctaaagataatgcggagcagatgaaggatgccgcggcggataaagcgcaggcaattaaacaggatgcggataaacaaatcgatacgctgaaaagccaggctgacgccgaggccgatcgcctgaaggatcaggccagcgccatcaaggccgaggcggacaagaaggcggacgccatcgcccagcaggcgaaagcccaggccgatgcggtgaagcagaacgcaaagcaggaaagtgaccgcatagtcaaagaggcgggtcagatcaaagacaacgccatcggtgacgccaatcagctctcggctgaagcggcgagcaaaaccaaagccatccaggacagtatcgcgaaggataaacagaacgccgcgccgcctgccgcacagcag

SEQ ID NO: 37 - DNA, 504 bp, Klebsiella pneumoniae; identical to SEQ ID NO: 4

SEQ ID NO: 38 - DNA, 2559 bp, Klebsiella pneumoniae
atgagcacaattgacaatctcgacgcccacacgccgatgatgcagcagtatctcaagctaaaggcgcaacatcctgacattctgctgttttaccggatgggggatttttacgagctattttatgacgatgcgaaacgcgcctcgcagctgctcgatatctcgctgaccaagcgcggcgcctccgcgggcgaaccgatacccatggccggcatcccccaccacgccgtagagaactacctcgccaaactggtcaatcagggcgagtcggtggccatttgcgagcagattggcgacccggccaccaccaaggggccggtcgagcgtaaagtggtgcgtatcgtcaccccgggcaccattagcgatgaagcgctgctgcaggagcgccaggacaacctgctggccgccatctggcaggacagcaaaggcttcggctacgcgacgctggatatcagctccgggcgctttcgtctgagcgaaccggccgaccgcgaaaccatggcggcagagctgcaacgcaccaacccggcggaactgctgtatgcggaagattttgccgaatcgtcgctgatcgagggccgccgcggtctgcgccgtcgcccgctgtgggaatttgaaatcgacaccgcgcgccagcagctaaacctgcagttcggcacccgcgatctggtcggcttcggcgtcgaaaacgccccgcgcggcctgtgcgccgccggctgcctgctgcagtatgtcaaagacacccagcgtacctcgctgccgcacatccgctccatcaccatggaacgccagcaggacagcatcattatggatgccgccacccgccgtaacctcgagatcacccagaatctggccggcggcaccgacaacaccctggcctcggtactcgactgtacggtgacgccgatgggtagccggatgctcaagcgctggctgcatatgccggtccgcgataccgccgtgctggtggagcgccagcagaccatcggcgcgctgcaggagcgctataccgagctgcagccggtgctgcgccaggtcggcgatctggagcgtattctggcgcgtctggcgctgcgtaccgcgcggccgcgcgatcttgcccgcatgcgtcatgccctgcagcaactgcctctgctgcgtgagctgctggccgacgttgacagtcagccggtgcaaaaattgcgcgagaaaatgggcgagttcaccgaactgcgcgaactgctggagcgtgcggtgatcgacgccccgccggtgttggtccgcgacggcggggtcatcgccccgggctatagcgaagagctggacgagtggcgggcgctggccgatggcgccaccgattatctcgataagctggagatccgcgagcgcgagcggctgggcctcgataccctgaaagtcggctacaacgccgtccacggctactacatccagatcagccgcggccagagccacctcgcgccgatccactacgtgcgccgccagacgctgaaaaacgccgaacgctatattattcctgagctgaaggaatacgaagataaggtgctgacctccaagggcaaagcgctggcgctggaaaaacagctttatgacgaactgttcgacctgctgctgccgcatctcgccgatctgcaaaccagcgccagcgcgctggccgagctggacgtgctggtcaacctggcggaacgcgcggaaaccctgaactactgctgcccgacctttagcgataagccaggcattcgcattagcgaaggccgccatccggtggtcgagcaggtgctgaaagagccgtttatcgctaacccgctgcagctggcgccgcagcggcggatgctgatcattaccgggccgaacatgggcggtaaaagtacctatatgcgccagaccgcgctaattgcgctactggcctatatcggcagctacgtcccggcgcagaaggtggagatcgggcccatcgatcgcatcttcacccgcgtcggcgcggcggatgacctggccagcggccgctcgacctttatggtggagatgactgaaaccgccaatatcctgcacaatgccaccgagcatagcctggtgctgatggatgagattggccgcggcacgtccacctacgacgggctatcgctggcgtgggcctgtgcggaaaatctggccaacaaaatcaaggcgctgacgctgttcgccacccactacttcgagctcacccagctgccggagaaaatggaaggcgtcgccaacgtccacctcgacgcgctggagcacggcgataccatcgcctttatgcacagcgtgcaggacggcgcggccagcaagagctatggcctggcggtcgccgcgctggcgggggtgccgaaagaggtgatcaagcgcgcgcggcagaaactgcgcgagctggagagtatctcgcccaacgcggcggcgacccaggtcgacggcacgcagatgtcgctactcgccgccccggaagagacctcgcctgcggttgaggcgctggagaatcttgatccggactccctgaccccgcgtcaggcgctggagtggatctaccgtctgaaaagcctggtc

SEQ ID NO: 39 - DNA, 1119 bp, Klebsiella pneumoniae
atgcgttacgtagatgaataccgcgcccccgaacaggtgatgcagctggtggcccatcttcagcagcgtgctcgtctgctgccgcataccgccgcgcgaccgctgcgcatcatggaggtctgcggcggccatacccatgccatttttaaattcgggctcgaccagctgttgccggagaacatcgaatttattcatggtcccggctgcccggtgtgcgtcctgccgatggggcgcatcgacgcctgcattgagattgccagccgcccgggagtgatcttctgcaccttcggcgacgccatgcgcgtgccgggtaaaaacggctcgcttctgcaggcgaaagcccgcggcgccgatgtccgcatcgtttactcgccgatggacgctctgcggctggcgcagcaaaatccgcagcgcgaggtggtcttttttggtcttggtttcgaaaccaccatgcccgctaccgccctgaccctgcgtcaggcgcgagagcgcaacgtcgataacttctactttttctgccagcacatcaccctgctgccgaccctgcgcagcctgctggaccagccggagaacggaatcgacgcctttctcgccccgggccacgtcagtatggtgatcggcaccgaggcctacggctttatcgccagcgactatcaccgtcctttagtggtcgccggtttcgaaccgcttgatctactgcaaggcgcggtgatgctggttgagcagacaatagcgcagcgcagcgatgtggaaaatcagtaccgtcgcgtggtgccggatgagggcaacccgctggcgcaggcggcgatggccgacgtcttccgcctggatggcgacagcgaatggcgcggcctgggggtcatcagcgactccggcgtgcagcttacgccagcctatcagcgcttcgatgccgaggcgcattttcgcccggcgccgcagcgcgtgtgcgacgacccgcgcgcccgctgcggcgaggtgctgaccggccgctgtaaaccgcaccagtgcccgctcttcgccagcacctgcaatccgcaaagcgcctttggcgcgctaatggtctcctctgaaggggcctgcgccgcctggtatcaatatcgcagtcaggaaaatgaagta

SEQ ID NO: 40 - DNA, 1218 bp, Klebsiella pneumoniae
atgacattttcagtagaacaggttcgcgccgattttccggtactgaaccgggaggtcaacggtcagccgctggtctatctcgacagcgccgccagcgcccagaagccggaggcagtgatcggcgccgaagcggaattctatcgccacggctacgcggcggtgcatcgtggcatccataccctcagcgcggaagccaccgcgcggatggaagccgtgcgtcagcaggcggccaccttccttaacgccgggtcggcggaggaagtggtgttcgtccgcggcaccaccgagggtatcaacctggtggccaacagctggggaaacgccaacgtcggcgccggggataacatcatcatcagcgaaatggagcaccacgccaatattgtgccgtggcagatgctgtgcgcccgcgtcggggctgagctgcgggtgatccccctgaacccggacggtacgctgcaactggatgttgtcccgggactgtttgacccgcgcacccgcctgctggcgataaccgaggtctccaacgtgctggggacggaaaacccgctggcggcgctgattgctcttgcgcatcagcatggcgcgaaagtgctggtggatggcgcccaggcggtgatgcaccacccggtggacgtccaggcgctgggctgcgatttttatgttttctccgcccacaagctgtacgggccgaccgggatcggcgtgctctacgcccggtccgagctgctgcagacgatggcgccttgggaagggggcgggtcgatgatcgccaccgtcagcctgacggagggcaccacctggaatcaggcgccgtggcgctttgaggccggcacgccgaataccggggggatcatcggcctcggcgcggcgctgacctacgtcagccagctgggactgacgcagattgccgagtatgagcagacgctgatgcgctacgcgctcgatgccctgcgcgcggtaccggatctgatcctttacggcccggcgcagcgtaaaggggtaattgctttcaacctcggtcagcatcacgcctatgacgtcggcagcttcctcgataactacgggatcgccgtgcggaccggacaccactgcgcgatgccgttgatggcccggtatcaggtaccggctatgtgtcgggcatcgctggcgatgtacaataccacggaagaggtggaccgcctggtggccggcctccagcggatccgcaaactgttaggg

SEQ ID NO: 41 - DNA, 1011 bp, Klebsiella pneumoniae
atggcgccatcccgcacattattggcccattcatccaccactggacgcatgcctgaggttcttctcgtgcctgatatgaagctttttgctggtaacgccaccccggaactagcacaacgtattgccaaccgcctgtacacttctcttggcgacgccgctgtaggtcgttttagcgacggcgaagtcagcgtacaaatcaatgaaaacgtacgcggtggtgatattttcatcatccagtccacttgtgctcccaccaatgacaacctgatggaactggttgttatggttgatgctctgcgtcgtgcttcggcaggtcgtatcaccgccgttatcccttacttcggttatgctcgtcaggaccgtcgtgttcgttctgctcgtgtgccaatcaccgcgaaagtggtggcggattttctgtccagcgtcggcgttgaccgcgtgctgaccgttgacctgcacgcagaacagatccagggcttcttcgatgtgccagtcgataacgtgttcggcagcccaatcctgctggaagatatgctgcagctgaacctggacaacccgattgtggtttctccggacatcggcggcgtcgtgcgtgcccgcgctatcgctaaactgctgaatgataccgatatggctatcatcgacaagcgccgtccgcgcgccaacgtctcccaggtgatgcacatcatcggcgacgttgccggtcgtgactgcgtgatggtcgacgatatgatcgacaccggcggcaccctgtgtaaagcggcagaagcgctgaaagagcgtggcgcgaaacgcgtattcgcttacgcgacgcacccaatcttctccggcaacgctatccagaacatcaaaaactctgtcattgatgaatttgtcgtctgcgataccattccgctggcaccagaaattaaagcgctggataaagtgcgtactctgacgctctccggtatgctggctgaagctattcgccgtatcagcaatgaagaatctatctctgctatgttcgaacat

SEQ ID NO: 42 - DNA, 744 bp, Klebsiella pneumoniae
atgagcgcaatgacccttgatttacctcgccgctttccgtggccaacgctgctgtccgtggctatccacggtgccgttgtggcggggctgctttatacctcggtacatcaggttattgaacagccttctccgacgcagccgatagagatcacaatggtggcgccggccgatcttgagccgcctccggcggcgcagcctgtcgtggagcccgttgttgaacccgaacctgagccggagccagaggtagtgcctgaaccgccgaaagaggcgccggtggtgatccataaaccggaacctaagccgaagcccaaacctaaacccaagcctaagccggagaaaaaggttgaacagccgaagcgggaagtgaagccggcagcagagccgcgtccggcctcgccgtttgaaaacaacaatacggcgccggcgcgtacagcgccaagtacctcgaccgcagcggctaaacccaccgttactgctccgagcggcccgcgggcgatcagccgcgttcagccgtcctatccgccgcgcgctcaggcgctgcgcattgaagggacggtacgggtgaagtttgacgtttcgcctgatggccgcattgataatctgcagatcctctctgctcagccggcgaatatgttcgaacgcgaggtgaaaagcgcgatgcgcagatggcgttatgagcagggaagaccgggtaccggcgtaacgatgaccatcaaattccgcctgaacggcgtcgagattaac

SEQ ID NO: 43 - DNA, 663 bp, Klebsiella pneumoniae
atgactcaaccagaagcagtattttttgactgtgacggcacgctggtcgacagcgaggtgatttgctcccgcgcctacgttcacatgtttcaggaattcggcattacgctggacctcgccgagatttttaagcgcttcaaaggtgtgaagctgtacgaaattatcgacaccatcaacgctgagtatggcgttaatctgcaaaaggccaccctggagccgatttaccgggcggaggtcgctcgcctgttcgatagcgagctggaggtgattcccggagcccaggcgctgctggatgcggtaagcgtcccgatgtgcgtggtttccaatggcccagtcagtaagatgcagcactcgctcggacgcaccggcctgctgcgccatttcactgaccgcttgtacagcggctacgatattcagcgctggaagcccgacccggcgctgatgtttcatgcggcagaggccatgcaggtaaaagccgaaaactgtattctggtggatgactccagcgccggcgctcagtcggggattgccgccggcatggaagtgttttatttctgcgccgatccgcacaaccagccgatcgatcatcccaaagtgacgacctttaccgatctggcagagctgccggcattgtggcaggcgcgcggctgggatatcacgcgt

SEQ ID NO: 44 - DNA, 1140 bp, Klebsiella pneumoniae
gtgcgccggctgcgtgaacgcggcgcggaagtgcgtgtcgcgatgacggaggcggcaaaagcgttcatcaccccactcagcctgcaggcggtatccggctatccggtttccgacagcctgctcgatccggcggcggaagcggcaatgggccatattgagctcggtaaatgggccgacctggtgatcctcgccccagcgaccgccgatttaatcgctcgcgtggcggccggcatggccaacgatctggtgtcgacgatctgtcttgccactccatccccggttgccgtggtgcccgccatgaaccagcagatgtatcgcgcgcaggccacccagcataatctgcagacgctcgctactcgcgggctgctgctatggggaccagacagcggtagccaggcctgcggcgacgtcggcccggggagaatgctcgatccgctaactatcgtagacatggccgcgcagcatttcgcctcccctgtcaaagatttgcaacatctcaacctcatgattaccgcgggcccgacccgtgagccattggatccggtgcgttatatcaccaaccacagctctggcaagatgggcttcgcgattgccgccgccgcagcgcagcggggcgcgaatgtgaccttgatcagcgggccggtatcgctaccgaccccgccgtttgtgcagcgcattgatgtcactaccgcgctggagatggaagcggccgtccaggctggcgcccagcagcagcacatttttattggctgcgccgcggtagcggattaccgcgccgccgtcatcgccgaagataaaataaaaaaacaaggtgatgaattaacaataaaaatggttaaaaacccggatatcgtggccggggtcgcggcgctaaaatcacatcgcccctacgtcgttgggtttgccgccgaaacgaataatgtggaagaatatgcgcggcaaaaacgtgcccgcaagaacctcgacctgatttgcgccaacgatgtttcccagcctaatcagggctttaacagcgacagcaacgcactacaccttttctggcaggatggggaaaagcgcttaccacttgagcgcaaggaactcctgggccaattattactcgacgagatcgtgacccgttatgatgaaaaaaatcgacgt

SEQ ID NO: 45 - DNA, 1362 bp, Klebsiella pneumoniae
atgtttcgtttaagttttatgtttatcgcgctcctgaccgcgggctgcgtctcgcttgacccgcattatgatcgcccggccgcgccggtgccggccaccctgcccggggcgcacggcgaatcgacggcggtggtcggcgactggcagaaagtggtcaatgacgcgcggctgaaaaaagtggtcagcatcgcgctgaacagcaaccgcgatgtgcaaaaggcgctagccgatatcgaggccgcgcgcgcccagtatggcgaaacgcgggcatcgctgtttcccaccgttgatgccgaactgagccacacccgcagcaaaacggtggccagcggcctgagctccgcttcacaggccgacggcgcggtctccagcttcgaactggacttgttcggcaagaaccagagcctgtcgcgcgcggcgcgcgaaacctggcttgccagcgaattcaccgcgcagaatacccggctgacgatgattgccgatttgaccaccgcctgggtgacgctggcgacggataacagcaatctggcgctggcgcagcagacgatggacagcgcggcaaactcgcgcaacatcgtcgcccaccagatggcggttggcaccgcctccgcgggtgatttaagctcggcggaaagcgtctatcagcaggcgcgcgccagcgtcgccagctatcgcacgctggtggcgcaggataaaaacgccattaacctgctggcgggggaaaccgtgccggagagcctgctgcccggcactctcgagagtctcggggataacagcatcgcgctggtgccggcgggcgtgtcgtcgtcggtgctgctgcgtcggccggacattcaggaagcggagcacaatctgaagagcgccaatgccgatatcggcgcggcgcgggcgaacttcttcccgtcgatttccctgaccgccagcgccggggtcggcagcgactcgctgtcgtcgctattcagccacgggatgcaggtgtggtcgttcgccccctccatcagcctgccgctgttcaccggcggcagcaacctggcgcagctacgctatgcggaagcggagaaaaaggggctgatcgccacctacgagaaatcgattcagagcgcgtttaaggacgttgccgatgcgctggcgcgccgggaaacgctgagcgaagagcttgatgctcagcggcagtatgtcgccgccgagcagacatcgctggatatcgccatgaagagctatcaggccggggtcggcgattatctgtcggtgctcaccgctcagcgcacgctgtggtcggcgaaaacgacgctgctgtccctgcagcagaccgacctcaataaccggatcaccctctggcagtcgctgggcggcggcgccagt

SEQ ID NO: 46 - DNA, 1539 bp, Klebsiella pneumoniae
atgcaactgaattccaccgaaatcagcgaactgatcaagcagcgcattgctcagttcaatgttgtgagcgaagctcataacgaaggtactattgtttctgtaagtgacggtgttatccgcatccacggccttgccgaatgtatgcagggcgagatgatctccctgccgggtaaccgttacgctatcgcactgaacctggagcgcgactccgtaggtgcggtggtaatgggtccgtacgctgacctcgccgaaggcatgaaggtgaaatgtactggccgtatcctggaagttccggtaggccgtggcctgctgggccgcgtggttaacaccctgggcgcgccaattgatggtaaaggtccgctggaaaacgacggtttctccgccgttgaagcgatcgcgccgggcgtaatcgaacgtcagtccgtcgatcagccggtacagaccggttacaaatccgttgacgccatgatcccaatcggtcgtggtcagcgtgaactgatcatcggcgaccgtcagaccggtaaaactgcgctggctatcgatgccatcatcaaccagcgtgattccggcatcaagtgcgtctatgtcgctatcggtcagaaagcgtccaccatctctaacgtggtgcgtaaactggaagagcacggcgcgctggctaacaccatcgtagtggtagcgactgcatctgaatctgctgcactgcaatacctggcgccatacgctggttgcgcaatgggcgaatacttccgcgaccgcggtgaagatgcgctgatcgtttacgatgatctgtctaaacaggctgttgcttatcgccagatctccctgctgctccgtcgtccgcctggacgtgaagcgttcccgggcgacgtattctacctccactctcgtctgctggagcgtgctgcgcgtgttaacgccgaatacgttgaagccttcaccaaaggtgaagtgaaagggaaaaccggttctctgaccgcgctgccgattatcgaaacgcaggcgggtgacgtttccgcattcgttccgaccaacgtaatctctattaccgatggtcagatcttcctggaaaccaacctgtttaacgccggtattcgtcctgcggttaacccgggtatctccgtatcccgtgttggtggtgcagcgcagaccaagatcatgaagaaactgtccggtggtatccgtaccgcgctggcgcagtatcgtgaactggcggcgttctcccagtttgcatccgaccttgacgatgcaacccgcaaacagctggaccacggtcagaaagtgaccgagctgctgaaacagaaacagtatgcgccgatgtccgtcgcgcagcagtctctggttctgttcgcagcagaacgtggttacctggctgatgtagaactggcgaaaatcggtagcttcgaagccgctctgctggcttacgtcgaccgtgatcacgctccgctgatgcaagagattaaccagtccggtggctataacgacgaaatcgaaggcaagctgaaaggcatcctcgattccttcaaagcaacccagtcctgg

SEQ ID NO: 47 - DNA, 2469 bp, Klebsiella pneumoniae
atggagcatgcccacccacaggtagacgcgaatcgcgtcatagctgccgatcggcggcttttcggttttcagctgccagcctttccctttctcatagcgcacccagtccggggtaaagcctttcggcgcggtctccagcagcaggcgcaggttactgtcgcgcagagcgggccacggcgcgccaaaacgcacaaagtaggtggccagctgcggcggaagatagctggggttaaaccgccagcctctgtcatcggcaaaaccgacttttcccggcagcagcatcgtgccgaggcccggcaccgccaccgtctcttcagcgacaatccgcgccagcagggctttaccggtctcggtgtactgcggctgttgccacaggcgccccgcctccagcagcgcccaggctatccacagatccgagtcggacgccgagttgctgtccagcagggtccactgctcatcgtcctttttgccccacagccagcccggcaaatgttgtttcagatcgccttccgccaggttgttctgcgtccaggtcagcagtttgtcgaaccctgcgcgatcgttggccgccagggcgaaaaacaggccatagctctgcccttcggaggtggagattttgcgcgcatcgctggggtcaatcacccgtccctcggggctgacgtacgcttgtttaaactgctcccaggcgggccactggcaggcggcgcccacctggcccgccgccagcagcagcgccgagagcaccgcgccacaaagtactttcatcatggtttactcatcatccaggctaagacggcggcggctgatgatgcgcagcatgcgccacagcacccatgccagcagcacaatgctgatggcggcgaagatcgccagcagtatcgggtggttagagagcgcgaaccagatgcgctcgaaccagggcagatgacccacgtagtaaatatcccccacccgcagactgttgacgccggattcgcggatcaccgccaccgagccaaacatcgctgcccgcttaccgctgtcgttgagggcgttggtcagcagttcatttccgcgcgggctgtcggccagcagggccaccacgctgcgctgatcgttatacggcgactggaagccaatcaccgccgccatcggcccggaagaggtaatgtcggtgcgggtattgggcgtgcgggcctcatcgtcgggataaatgctcgccaggtcatagtggcgcatcggcattttcacccagcttttggtcgcctcgaccagcaggttgattttggtgtcgtccttgagcgacgacgggatcgcgccgatcagcagcagatccgcatctttgttcttgatctggttgccatcgtcggtcatttgcagattaatcgccgccagaccggtctgcgaaccgatgccccccagcgcctgcagcagcgtcgccacctggccctgggtcggcgccttcggcaccaccaccagcgtgtcggaaaggtccgccatacggctgtaagggaagcccgcattggcgaagacgcgcaggtccggcaaggcgataaagtgataatacttcgagaagtcgatggtcgaatcgtcgccgatcaccacgtggttctgcaccggctggaaggtaatacagttgtcgatggagccgccgggcatcgggttcatatactggaagtcaaagcgcagctggttgaccgccccaagacgcagcgcggggatggtgacctccgatttgccgtccagcagcccctgcagcaccggcaggcgcaggatcagtttgttcacgtcctgggagctgttaaggctgaacgactgcaggaactggtcgttgaggctgatatccatccgcgagctgtccttcaccggcggcatggtgtagcggtatttcagatccatatcgatgccgttggcccgcagcagatagagatccggcggcaggttaagcgccacggtgatggcatccggcaccaggccgctggactgcagctgttgctcataggttttcagctcagcaaaggtgaccgaacggtcggtgcgcacccagttcggcgcgtcgtaaggctgacgcggctgcagggttttgatgccgtccacggtgacgctgctgccgcggaacagaatattgccctgagcaatccccttcgccgccagcagcaggtcgttatcatcgcggccgaaaatcaccagcagcttgacgtagggatcgttcgggttgtcgatcatttcgatggtcggcgccttgaccggcggatgatcgcgcaggaagtccggacgcttgtcgttggtggcgaagacaatggcgttacgatccggcagttcattgaaatagaccgggaactgctggccgcgccagccggccttgctgccgaaccaggaggcgactatcgccgccgcctgctgctgggtgaccgctggcgagcccgggaaaatcatcggcagcttcagcgggcggttatcgcgcggatcgtagaacggcaccgggaagtg

SEQ ID NO: 48 - DNA, 1191 bp, Klebsiella pneumoniae
gtggaaaggtttgatgccattgtcgttggcgccggagcggcgggtatgttttgcgcagcgcaggcgggccagctcggctgccgcgtcctgctgctggataacggcaaaaagccggggcgaaaaattctgatgtccggcggcggccgctgcaactttaccaacatgtatgttgaaccgacggcctatttgagccaaaacccgcatttttgcaaatctgccctggcgcgctacacccagtgggactttatcgagctggtcggcaaatatggcatcgcctggcatgagaagaccctcggccagctgttttgcgatgattcggcggagcagatcgtcaatctgctgctcgcggaatgtgaaaagggcggcgtgcagatccgtctgcgcagcgaaatcctcagcgtggagcgcgatgaacaaggctaccggctacaggtgaacggcgaaacgctgatgaccaaaaagctggtgatcgcctccggcggtctgtcgatgccggggctcggcgcctcgccgtttggctataaagtcgccgagcagttcggcctgaaggtgctgccgacccgcgcggggctggtgccgtttaccctccacaagccattgcttgagcagctgcaggtcctctccggcgtgtcggtgccgtcgaccattaccgccgagaacggcactctgtttcgcgaaaatctgctgttcacccaccgcggcctttccggaccggcggtgctgcaaatttccagctactggcagcccggcgagttcgtcaccgttaatctgctaccggactgcgatcttgatgacttccttaacgagcagcgcagcgcgcatcccaaccagagcctgaagaacaccctggcgatgcagctgccgaagcggctggtggagtgtctgcagcagctggggcagatacctgatgtgacgctcaagcaactgaacgttcgcgatcagcagacgctggtggagacgttaaccgcctggcgcgtgcagccgaacggcaccgaaggctaccggacggcggaggtgaccctcggcggcgtggacaccaacgaactctcgtcgcgtactatggaggcgcgtaaggcgccgggtctctactttatcggcgaagtgatggacgttaccggctggctcggggggtataacttccagtgggcgtggtcaagcgcctgggcctgcgcgcaggcgctggtggaaggg

SEQ ID NO: 49 - DNA, 675 bp, Klebsiella pneumoniae
atgaagcagtatttgattgccccttcgattctgtcggctgattttgcccgtctgggtgaggataccgcgaaggcgctggcggcgggtgcggatgtcgtgcacttcgacgttatggacaaccactacgtgccaaacctgacgattggcccgatggtgctgaagtcactgcgtaattacggtattaccgcgccaatcgacgttcacctgatggtgaagccggtcgaccgcatcattcctgattttgccgaagccggcgccagcattatcaccttccatccggaagcctccgaacacgtcgatcgcagcctgcagcttatcaaagagcacggctgtaaagcgggcctggtgtttaacccggcgacgccgctgagctacctcgattacgtgatggataagctggacgtgatcctgctgatgtcggttaacccgggctttggcggccagtcctttattccccagacgctggataaactgcgtgaagtgcgccagcgcatcgatgcgtccggctacgacatccgcctggaagtggatggcggcgtgaaagccagcaatatcggcgaaatcgccgcggcgggtgcggatatgtttgttgccggttcggcgatcttcggtcagccggactacaagcaagtcattgatcaaatgcgtagtgaattagcgaaggtgagtcatgga

SEQ ID NO: 50 - DNA, 2502 bp, Klebsiella pneumoniae
gtggaaaacccgtcgcagccagcgcaatcgggcaacagtggcgaaaacggcgcaggaggatgggacgttatgaagcgattaaccacgctggcgctgctggcagggatgctctctgcgcctgcgctacacagtgaagaaccgggctccggcgccgctgccccgctgagcttcccgcagctcaacgacgcggcggacagcgagcccggcgacgaacctccggctgcctcgccggaggagggcgcctctccggcagcccccgccaccgccggcgatgcggcggcgacggcccctgcgccggttatgccggacttacccccgccggtgagcggcacggccgcgccggaggtcattcctgtcgctccggtctggggaggcgatctgaatctggcgcagatggggatgccggacgggattatcctcagcggcggccagcgacagggtggggtcagctttaccctgcctgccgatcaggtggtgatccattcgcagctcagccttgccgttcgcgtatcgccggagatggcgagccgcaacgccaccctgcagctgatgctcaacggtcaaccgctcggcacgctgccgctgggcgccgatggcgaggatgtctcccattatcagctggatattccgcccgcgctgatggtctccagcaataacctgagcgtgaagatcaacgatggcgataccctgcagtgccagcgtgacattcatgatacgtcgcgggtgacggtgctgcccacgtcgcatttcagctgggaaagccagcagctgaacatcagcgacgacctgagccacttcccgcggcccttctttgacagcatgcagatgaccccggcggacattgcggtcgcctatggggccaagccgtcggcggacgtcttcagcgccgcggcgctgatctcctcctggctgggtatccaggcggactatcgcggcattgccttcagcgctctgcgcgaccgtctgccggaacgccacggcatcgtgattggccatccgggggagcaggtgggcggcatgatgctgccggaaaccgataagccgctgctgcgcatcatcgccaaccccgccaatccggcctataaactgctgctgattgtcggtaaaaacgatacggcgctgcgcatggccgcctggcggttaacccgcggcaactttgcgccgcaaaccgcgacgctggatgtcgaaccgcagaccatcccggttggcaaagcatatgatgccccgcgctggatccccaccgatcgtccggtcaagctcagcgagctgctgcgtaaggaccaaagcccgaccgtcagcggcgtctggcacgaacctttacgtatcgccttccgcgccgcgcccgatctctatctgtgggatggggagaccattccgctacaggttggctaccgcttcccgtcggaaagctggattaatgaggacaagtccttgctgagcgtcacgctcaatggcaccttcctcaacaacctgccgatgaacaagcaggggccgctggagaaagtctggcgctacctcgggggcgatgcgcgccaggagcgctttaccatcccgctggcgccttacctgatttacggcgataaccagctgtcgatgtacttcaatgtggtgccaaaggacgatgttccgtgttcggtgctgctgaataacaatatcaagagccggatcactgacgactcctggatcgatttgagcaagacgcgtcacttctcgctgttgcccaatctctcctactttgtcggcgcctcgttccccttctcgcggctggcggactattcgcagacgaccctcctgctgccggcggacccgtctgaaacccaggtggcgaccctgctgaatctggcggcacgctccgggaacgcgaccggcaccgcgctggcgaataaccgcgtcgtgctcgggatgcccaccggcgggggggatttgcagtcgctgcgtgaacgtgacgtgctggcggtcaccgctctcgatcagcaggcctttaaccagagcctgctggccgactcaccctatcgcccggtagataatgtgctgagcgtccgcgagccagacctgtggcaaaaagtccagcgccggctcaccggcgactggacttccgccagcctcgacgccgatcgctacttttcgtcgagcagcgcctggcgcgggttcatcagctatcgctcgccgtggaattccacccgcctggtggtggtggcgctggccagcaatgatgaccagctggcgcgactgaagaccgatctggaatcgccgcgcattaacgccgggatccgcggcgataccgcggtgatcaccagcgataacggggtgcgcagcttccaggtgagtacgccgttccccagcggtcagatgccgtggtacatgatggcggtctggtatgccagccagcactcaggtttcctggcggtgctggggctgattgccacctcgataatgggactggcgctgaccgcgatgtttaaacgtcacgcccgtaagcgtctgggttcgggggataaccaa

SEQ ID NO: 51 - DNA, 411 bp, Klebsiella pneumoniae
atgaggccctggtgtacgtcgaaagcgaagtcgaaaacggcttaccgccggtgccggctaactggcaattgtatcgtgaaaaagtggccggacaggtcgcctaccgtctttaccaacgtgaggcccaaggagagcaccatgctgattaatttaggccgcctgctgatgctgtgcgtctgggcctttctgttattgaatctgtttcagcccttcccgaagccgctgaatatctttgtcaacgtcgcgctgattttcatgatcctgatgcacggtctgcagctgacgctgctcaaggcgacgcagccgaaagaggcgccgccgctgagccgctttgagcaaatccgcatttttattttcggcgtgtttgagctcgtggcctggcagaaaaaactgaaggcgacgctgaaaaaa

SEQ ID NO: 52 - DNA, 501 bp, Klebsiella pneumoniae
atggctcacatcgaaaaacaagctggcgaactgcaggaaaagctgatcgcggtaaaccgcgtatctaaaaccgttaaaggtggtcgtattttctccttcacagctctgactgtagtaggcgatggtaacggtcgcgttggttttggttacggtaaagcgcgtgaagttccagcagcgatccagaaagcgatggaaaaagcccgtcgcaatatgattaacgtcgcgctgaaccacggcaccctgcagcacccggttaagggtactcacacgggttctcgtgtattcatgcagccggcttccgaaggtaccggtatcatcgccggtggtgcaatgcgcgccgttctggaagtcgctggggttcgtaacgttctggctaaagcgtatggttccactaacccgattaacgtggttcgtgcaactatcgacggtctggaaaacatgaagtccccggatatggtcgctgccaagcgtggtaaatccgttgaagaaattctggggaaa

SEQ ID NO: 53 - DNA, 2541 bp, Klebsiella pneumoniae
atgagcaaagtcagaatcgctattatcggtaacggcatggttggccatcgctttatcgaagagcttctcgataaggcgcctgccggacagttcgacattaccgtgttctgtgaagaaccgcgtatcgcctacgaccgcgtccacctgtcgtcttatttctcccatcacactgcggaagaactgtcgctggtacgcgaaggtttctatgagaaacacggcgtcaaggtgctggtcggcgaacgggcgatcaccatcaaccgccaggagaaagtgatccactccagcgccgggcgtaccgtgttctacgacaagctgattatggcgaccggttcatacccgtggatcccgccgattaaaggcgcggaaacccaggattgcttcgtctatcgcactattgaagatcttaacgccatcgaatcctgcgcccgccgcagcaaacgcggcgcggtagtcggcggcggcctgctcggcctggaagcggccggagcgttgaaaaacctcggcgtggaaacccatgttatcgaattcgcgccgatgctgatggccgaacagctcgaccagatgggcggcgagcagttgcggcgcaaaatcgaaagcatgggcgtgaaagttcacaccagcaaaaacaccaaagagattgttcagcagggcaccgaggcgcgcaaaaccatgcacttcgccgacggtagcgagctgcaggtcgatttcatcgtcttctcaaccgggatccgcccgcgcgataagctggccacccagtgcgggctggcggtcgcccagcgcggcggcatcatggtcaacgatagctgccagacctccgatccggatatctatgccatcggggaatgcgccagctggaacaaccgcgtctacggtctggtcgcccccggctataaaatggcccaggtggccgtcgaccatctcctcggcagtgaaaatagcttcaccggcgccgacctcagcgccaagctgaagctgttgggtgtggacgtgggcgggatcggcgatgcccacggccgcacgccgggcgcccgtagctacgtctatctcgacgaaagcaaagaagtttataagcgcctgatcgtcagcgccgacaacaaaacgctgctcggcgcggtactggtcggcgacaccagcgactacggcaatctgctgcagctggtgctcaacgccatcgagctgccggaaaacccggattcgctgatcctcccggcccacgccggcagcggcaagccatcgatcggcgtggataaactgccggacagcgcgcagatctgctcctgctttgacgtcagcaaaggcgacctgatcgccgctatcaacaaaggctgccacaccgtggcggcgctgaaagcggaaaccaaagccgggaccggctgcgggggctgtattccgctggtcactcaggtgctcaacgccgagctggcgaaacagggcattgaggtcaacaacaatctgtgcgaacacttcgcttactcccgtcaggagctgttccacctgatccgcgtggaaggcatcaaaaccttcgacgagctgctggaaaaacacggtcagggctacggctgtgaagtctgtaagccgaccgtcggttccctgctggcctcctgctggaatgagtacatcctcaagccgcagcacacgccgctgcaggacagcaacgacaacttcctcgccaacattcagaaagatggtacctattcggtgatcccgcgctcagctggcggcgaaatcacgccggaagggctggtcgccgtgggccgtatcgcgcgtgaattcaatctgtacaccaaaatcaccggctctcagcgcatcggcctgtttggcgcgcagaaagacgacctgccggagatctggcggcagctgattgaagcgggattcgaaaccggccacgcctacgccaaagcgctgcgaatggcgaaaacctgcgtcggcagcacctggtgccgctacggcgttggcgacagcgtcggcttcggcgtggaactggaaaaccgctacaaaggcatccgcaccccgcacaaaatgaagttcggcgtctccggctgcacccgcgaatgtgccgaggctcagggcaaagacgtcgggatcatcgccaccgagaaaggctggaacctgtacgtttgcggtaacggcgggatgaaaccgcgccacgccgatctactggccgcggacctcgatcgcgagacgctcatcaaatatctcgaccgctttatgatgttctacatccgcaccgccgataagctgacccgcactgccccgtggctggacaatatggaaggcggtatcgactatctgcgcagcgtcatcatcgatgacaagctcggtctgaacgaccatctggaagaagaactggctcgcctgcgcgccgccttcgcctgcgagtggaccgagaccgtcaacaacccggcggcgcagacccgcttcaaacactttatcaacagcgaccagcgcgacccgaacgttcaggtggtgccggaacgtgaccagcaccgcccggccacgccgtatgagcgtatcccggttactctggtggaggaaaaagca

SEQ ID NO: 54 - DNA, 4989 bp, Klebsiella pneumoniae
gtgacaaattgcatcaggctcatcggccgaggggttagaaggatgaaaccatttcgtttagcggcgctatcactagcgctccttaccgcattttcattaaccgggtgtgatgacagcggtacaccgcaggcctcggccccggcgccagccgcggatagcaacccaggcgcgacggcaaaaccggaccgcgcccagctggcggcgctggcggaaaaaagccagggtaaagcgctgacgctcctcgacgcctcggaggtgcaactggatggcgccgcgaccctggtgctgacgttttccgtcccgctgcagccggaccaggatttctcccgcagcgtgcatctggtcgacaagaaaagcggtaaggtggacggtgcctgggagctggcgccgaatctgaaagagctgcgtctgcgtcaccttgagccaaagcgcgagctgattgtctcggtcgacccgacgctgaccgccctgaacaaggcgacgctcgacaaaccgtttgagaagaccctgaccacccgcgatatcgcaccgagcgttgggtttgccagccgcggctcgctgctgccgggcaacgtggtcgccgggctgccggtgatggcgctgaacgtcgataatgtcgacgttaatttcttccgcattaagccggaatcgctctccgcctttgtcagtcagtgggaataccgtaactcgttaagcaactgggaatctgatgaactgctgaagatggcggatctggtctacagcggccgcttcgatctcaacccggcgcgtaatactcgcgaaaagctgctgctgccgctgagcgacatcaagccgctccagcagcctggcgtctacgtggcggtcatgaacccggcgggccgttatagctacagcaacgcggcgacgctgtttaccctcagcgatatcggcgtctcggcgcatcgctaccataaccggctggacgtttttacccagagtctggaaaacggcgccgcccagtcgggcattgaggtgcagttgctcaatgccaaagggcagaccctggcggaagcgaaaagcgacagccagggccacgtcaccctgcaaaccgataaagaagccgcgctgctgctggcgcgcaaagaggggcagaccacgctgctcgacctcaagctgccggcgctggatctggcggaattctctatcgcaggcgcgcccggctttagcaaacagttctttatgtttggcccgcgcgatctctatcgtcccggcgaaacggtgatccttaatgcgctgttgcgcgatagcgacggcaagccgctggcggagcagccggtgaaactcgaggtggttcagccggacggccaggtgatccgctcggtgatgagcaaaccagtgaatggcctgtaccagtttacttatccgctcgacagcggcgcggctaccggcatgtggcacattcgcgccagcgccggcgacaatcagccgcgcgaatgggatttccacgttgaagactttatgccggaacgcatggccctgaacctgacgccgcaggccgcgccagtcgcgccggatgccgacgtcacctttggcgttagcggcgcttatctctacggcgcgccggccagcggcaaccagctgcagggcaagctgttcctgcgcccgctgcgcgacgccgtcgctgcgctgccgggcttccagttcggcgatattgcggaagaaaacctctcccgtagtctggatgaagtccagctgacgctggacgaaaaaggccatggcgaagtgaccacctcaagccagtggcaggatagccattcgccgctgcaggtggtgttgcaggccagcctgctggaatccggcggtcgcccggtgacccgtacggttaagcagccgatctggcccgccgaggcgctgccggggatccgcccgcaatttacgctgaaggacgtttacgattaccgcaccgataccaccgtcaaacagccggtggtggatgaaaacagtaacgccgcgtttgatatcgtctatgccgacgtcaaaggcgagaaaaaagcgatctccggtctccaggtgcggctgatccgcgagcggcgcgactactactggaactggtccgacagcgaaggttggcagtcgcagttcgatcaaaaagatctgcaggagggcgaggagtcgctggacctgcaggccggccagatcggcaaagtgagcttcccggtggagtggggatcctatcgcctggaggtgaaaggaccggacgacgtggtcagcagcgtgcgcttctgggcgggctacagctggcaggataacagcgaaggcgccggcgcggcgcgtcctgaccgggtcaccatgaagctggataaaccgagctataaaccgggcgacaccatcaggctgcacatcgccgccccggcggcgggtaaaggctacgcaatggtggaatccagcgaagggccgctgtggtggcaggaaattgacgtcccggcggaggggatggacctgtcgatcccggtggataaaacctggaatcgccacgacctctacctcagcacgctggtggttcgtcccggcgataaatcgcgctcggcaacgccgaaacgcgcggtgggcctgctgcatctgccgctgggcgatgaaaaccgtcgcctgacgctggcgctggaggccccggacaaaatgcgccccaaccagccgctgacggtgaaagtgaaagccagcgtcaaagagggcgaggcgccgaaacaggtcaatgtcctgctctcggcggtggatagcggggtactgaatatcaccgattacgctaccccggatccgtggaacgccttctttggccagaagcgttacggcgcagatatctatgacatctacggccaggtgatcgaagggcaggggcgggtggccagcctgcgcttcggcggcgatggcgacgagttaaaacgcggcggcaaaccgccggtcaaccacgtgacgatcgtcgcccagcaggcgcagccggtggtattgaacgatcagggcgaaggcacggtgacgttacccattggcgattttaacggcgagctgcgggtgatggcccaggcgtggacggcggatgacttcggcagcagcgaagataaagtggtggtggccgccccggtcatcgccgaactgaacaccccgcgcttcctcgccagcggcgataccacacggctggcgctggatctcagcaatctgaccgataaaccgcaaaccctgcaggttcatcttaccgccagcgggctggtgaccttgaccgagggtcaactgccgccggtgcaactggcgccgggggcgcgcagcacgctgtttataccagtgagcgcgctggcgggcttcggcgatggtcaggttaatgccaccatcagcggcctgagcctgccgggcgaaaccttcgccccgctgcaaaaacagtggaaaatcggcgtgcgtccggcgtacccggcacagaccgtcaacagcggcgcagtgctgcagccaggtgaaagctggcagccgccggcggcgcagagccagggctttgccccgcaaacgctgcagggccaactgctgctcagcggtaaaccaccgttgaatctcgcccgctatatccgcgagctgaaagcctatccttacggctgccttgagcagaccgccagcggcctgttcccgtccctgtataccagcgcggcgcagctaaaggcgctgggcattagcggggacagcgacgaaaaacgccgcgcggccatcgatgtcggtatttcacgcctgctgcagatgcagctggaaaacggcggctttgcgctatgggatagagaggggccggaagagtactggctgaccgcctacgccatggacttcctcgtgcgcgccagcgagcagggctatagcgtaccggtcaacgccattaataaaggcaacgagcgcctactgcgctatctgcaggagccaggcctgatgaccgtgcgctacagcgacgacgcccaggctagccgctttgccgctcaggcatacgccgcgctggtgctggcgcgtcagcaaaaagcgccgctcggcgccttgcgtgaaatctggagccgtcacgaccaggcgcgatccggcttgccgctgctgcagctcggcattgcgctgaaaaccatgggcgatgcgccgcgcggcgacgccgccctgaagctggcggttgccaccccgcgccaggatgagaatcgttggctgggcgattacggtagcccgctgcgcgataacgccctgaagctggcgctgctggaagagaataaactgctgccggaggtgcaaaatcagctgttgagcacgctgtcggaagaggcctatggccagcgctggctgtcgacccaggaaaccaacgccttgttccttgccggacgtacgctggcggacctgccgggcagctggcaggcgaaaacctcgctgcaggcggagccgttggccggcgacaaagcgcaaacccgcaacctcgacggcgatcggctggcggcgctgcaggtgagtaataccggcagtcagccgctgtggctgcgtctcgacagcagcggctatccgcaaagcgcgccgcagccgggcggtaacgtcctggggattgaacgcactattttcgatacccaggggcagcagaaatcgctgtcttcactgcgcagcggcgaactggtgctcgtcaagctggaggtgaccgccaaacgcaacgtgcctgacgcgctggtggttgatctgttgccagccggtctggagctggaaaaccagaatctggccaacagcagcgccagcctgcaggagaatggcgacgcggtgcaaaacctgcttaaccagatgcagcaggcggatattcagcatatcgagttccgcgatgaccgctttgtcgccgccgtcgctgtcaatgaaggccagccggtgacgctggtctatctggcgcgggcggtgacgccgggcacttatcaggtcccgcagccgcaggtggaatcgatgtatgcgccgcagtggcgggcgacaggagcggccagcggtccgctcaccgtgacgccg

SEQ ID NO: 55 - DNA, 735 bp, Klebsiella pneumoniae; identical to SEQ ID NO: 8

SEQ ID NO: 56 - DNA, 651 bp, Klebsiella pneumoniae
gtgattaatttaaatggaaattcatcatcttctcgtcaggtaacctttattacccacccgtctattcaaagcaaagcctttgccagctatctgagcgaaaccctgatggcaccggtggttttacaaaatattaataaaccgctggcgcagcgtttggcaaaagattctgtaatattatttgatattgcagtgtcaaataagaaattaaacggggtgtggcgggatattattcgcctgcaggcagataatcctcgtttgttgattattaatagcgcacaaaagtatgagctatacgaaatggcgcagtggccggctttatatggcgtgttccgtcatgacgatgatgaatcgcgcttaattgagggcgttaaggccgtactgaacggcgagcagacggctgaattgagcgtgatgcacccggcgatgtacgctgcggaccatgcatcgactccagtagagaactcgccgctgaccgagcgggaatgcgagatcctcaacgaactgcgctgcggcgcaacgaacctggatatcgcccgcgcgctgtttatcagcgagaacacggtgcggacgcacctgtacaatgtgtttcgtaaactgagcgtgaaaaatcgcacccaggcggtgagctgggctaacgaacatctgcgccac

SEQ ID NO: 57 - DNA, 1152 bp, Klebsiella pneumoniae
atggcaaaacacctttttacgtctgagtccgtatcagaagggcatcctgacaaaattgctgaccaaatctccgatgccgtgctggatgcgatcctcgagcaggatccgaaagcgcgtgtcgcatgtgaaacctatgtcaaaaccggcatggtgctggtaggcggcgaaatcaccaccagcgcatgggttgatatcgaagagatcacccgcaacaccgtccgcgaaattggctacgtgcattccgatatgggctttgacgccaactcgtgcgccgtactgagcgccattggtaaacagtctccggacattaaccagggcgttgaccgtgccgatccgctggaacagggcgccggcgaccaggggctgatgtttggctacgccactaacgaaaccgacgtgctgatgccggcgccggtgacttacgctcaccgtctggtgcagcgtcaggctgaagtgcgtaaaaacggcaccctgccgtggctgcgcccggatgcgaaaagccaggtgaccttccagtatgacgacggcaaaatcgtcggcatcgacgcggtcgttctgtcgactcagcacgcggaagatatcgatcagaaatccctgcaggaagcagtgatggaagagatcatcaagccgattctgccgaccgaatggctcaacgcgtccaccaaattcttcatcaacccgaccggccgtttcgttattggcggcccgatgggcgactgcggtctgaccggtcgtaagatcatcgttgatacctacggcggcatggctcgccacggcggcggcgcgttctccggtaaagatccatctaaagttgaccgttccgcagcctacgcggcgcgctatgtggcgaagaacatcgttgccgcaggcctggccgatcgttgcgaaattcaggtttcctacgctatcggcgttgcagaaccgacgtccatcatggtggaaacctttggcaccgagaaagtgccttctgaacagctgaccctgctggtgcgcgagttcttcgacctgcgtccatacggtctgattcagatgctggatctgctgcacccgatctacaaagaaaccgcagcctacggtcactttggtcgcgaacatttcccatgggaaaaaaccgacaaagcggcgctgctgcgggaagcggccggtctgaaa

SEQ ID NO: 58 - DNA, 1470 bp, Klebsiella pneumoniae
atgccgaggaaattctgttccggtttggctttcgccatcgccaccagcgaggcgcccatcccgaagccaatttctaaggtgaccggcgcgtcacggccaaacagggcggcgaaatcgagcggcgcatcgttgaattcaacgcccatcaccggccaaatgttatccagcgcatgctgctgccctttcgtcaggcggccctggcgacggacgaagctacgaatacggcgcagcgggcgaccgttttcatcgaattccggagagatgacgtcgtttttcataaaagtttggtctgcttgtgaatgtgttcggaaaacgggcattatccaaagttactcggcggatgcaagggtttacagccactcgcccttatgctgcaatctgcccccctgtaatcgcgatcccggagccgtagctttgacttttctcgccacgcaattttcagcccaggttctggactggtacgacaaatacgggcgtaaaaccctgccctggcaaatcgccaagacgccctacaaagtatggctctccgaagtgatgttgcaacaaacccaggtgaccacggtaatcccctattttgaacgctttatggcgcgtttccccacggtggtggatctcgccaacgcgccgctggatgaagtgctgcatctgtggaccggtctgggctactacgcgcgggcgcgcaacttacataaagccgcgcagcaagtcgccacactgcacggcggggaattcccccggacctttgacgaagtggcggcgctgcccggcgtcgggcgctcaacggcgggggcgattttatccctttcgctcggtcagcattatccgattctcgacggcaacgtgaagcgcgtgctcgcccgctgctatgctgtcagcggctggccggggaaaaaagaggtggaaaaacggctgtgggacatcagcgaagaggtcaccccggcagagggcgtcgagcgcttcaaccaggcgatgatggatctcggggcaatggtttgtacccgctcgaagccgaagtgcgagctatgtccgctgagcaacggctgcgtggcctacgcgaaccattcatgggcggaatatccgggcaaaaaaccgaagcagaccctcccggaacgcaccggctacttcctgctgatgcagcacggcgacgaggtgtttctttcccagcgtccgccggtgggtctgtggggcgggttgttctgttttccgcagtttgcagacgaagcggagctacgcgagtggctggcgcagcgccagataaaggccgataatctgacgcaattaaccgcttttcgccacactttcagccatttccacctggatattgtgccgatgtggcttacagtgcactcatctggcgcatgcatggatgaaggcaacgcactctggtataacttagcgcagccgccgtcggtcggtctggcggcccccgtggagcgcttgttgcaacagctaaaagccggagcgccggta

SEQ ID NO: 59 - DNA, 294 bp, Klebsiella pneumoniae
gtgacttactggtctcccgtatctgcatgggatgtatggggtttggcaatccgtcaacgggtcagcatcgctggacgctggacgaaacagccagccgggacatcatccgccacgctctggaacagggcatcaatttttacgataccgccatcgcctatcagaacggctccagcgaacggtacgttggccgggcgctgcgggagatggcaaaacgcgaggaggtggtgctggccaccaagtttctgccacgaaccgccgcgcagattgccgaggggatcagcggaaaacaggcta

SEQ ID NO: 60 - DNA, 2109 bp, Klebsiella pneumoniae
atgtacatgacttgtcgcttgggttacattgttcacacttttttccggcgtagcccaaaacgcgctctcgtcaagtcgttaagggcatggccttcaacagtccgaactggagtcaaaatgtcctcacgtaaagagcttgctaacgctattcgtgcgctgagcatggacgctgtacagaaagccaaatccggccacccgggggccccgatgggtatggctgacattgccgaagtgctgtggcgtgatttcctgaaccataacccgaacaatccggcctgggctgaccgtgaccgttttgtgttgtcaaatggccatggttcgatgctgatttacagcctgctgcacctcactggctacgatctgccgattgaagagctgaaaaacttccgccagctgcactccaaaaccccgggtcacccggaagtcggctacaccgcaggcgtggaaaccaccaccggtccgctgggccagggtatcgctaacgcggtcgggatggctatcgccgagaaaaccctggcggcgcagttcaaccgtccgggacacgatatcgtcgaccactacacctacgccttcatgggcgacggctgcatgatggaaggcatttctcacgaagtgtgctccctggccggtaccctgaaactgggtaaactggtggcgttctatgatgacaacggcatctccatcgacggccacgttgaaggctggttcaccgacgacaccgccaaacgctttgaagcctacggctggcacgtggtgcgcggcgtggacggtcacgacgctgacgccatcaaacgcgcggtagaagaagcgcgggcggtcaccgacaaaccgtccctgctgatgtgtaaaaccatcatcggtttcggttcgccgaacaaagccggtacccacgactcccacggcgcgccgctgggcgacgccgaaatcgccctgacccgcgaagcgctgggctggaaacacgcgccgtttgacatcccgtctgacatctatgcccagtgggatgccaaagaagccggccaggcgaaagaagccgcatggaacgagaagtttgcggcttacgccaaagccttcccgcaggaagcagccgaattcacccgccgtatgaaaggcgagatgccgtctgacttcgacgcgaaagctaacgagttcatcgcgaagctgcaggccaacccggcgaaaatcgccagccgtaaagcctcgcagaacgccatcgaagccttcggcccgctgctgccggaattcctcggcggctccgcagatctcgcgccgtccaacctgaccctgtggtccggctctaagccgatcaacgaagacgctgccgggaactacatccactacggcgtgcgcgagttcggtatgaccgctatcgccaacggtatcgcgctgcacggcggcttcctgccgtacacctccaccttcctgatgttcgtggaatacgcgcgtaacgcggtacgtatggccgcgctgatgaaacagcgtcaggtgatggtctacacccacgactcgatcggtctgggcgaagacggcccgactcaccagccggtagagcaggtggcttccctgcgcgtgaccccgaacatgtccacctggcgtccgtgtgaccaggttgaatccgcgattgcgtggaaatatggcgtggagcgtcaggacggcccgaccgcgctgatcctctcccgtcagaacctggcgcagcaggagcgtaccgcagagcagctggcgaacgtggcccgcggcggttatgtgctgaaagagtgcaccggctcgcagccggagctgatcttcatcgccaccggttcagaagtggagctggcggttgccgcatgggacaaactgactgccgaaggcgtgaaggcgcgcgtggtttccatgccgtccaccgacgcgttcgacaagcaggatgcggcttatcgcgaatccgtactgccgaaagccgtgaccgcgcgcgttgccgtggaagcgggtatcgctgactactggttcaaatacgttggcctgaacggcgctatcgttggcatgaccaccttcggtgagtctgcgccggctgagcagctgttcgaggagttcggcttcaccgttgataacgtggtcgctaaagcgaaagcgctgctg

SEQ ID NO: 61 - DNA, 759 bp, Klebsiella pneumoniae
atgcccgttttccgaacacattcacaagcagaccaaacttttatgaaaaacgacgtcatctctccggaattcgatgaaaacggtcgcccgctgcgccgtattcgtagcttcgtccgtcgccagggccgcctgacgaaagggcagcagcatgcgctggataacatttggccggtgatgggcgttgaattcaacgatgcgccgctcgatttcgccgccctgtttggccgtgacgcgccggtcaccttagaaattggcttcgggatgggcgcctcgctggtggcgatggcgaaagccaaaccggaacagaatttcctcggcattgaagtacactccccgggcgttggcgcttgtctggcttctgcggaagaagaaggcgtacaaaacctgcgcgtaatgtgtcacgatgcggtggaagtgctgcataccatgatcccggataactcgctgaatatggtgcaactgtttttccctgatccgtggcataaagcgcgtcataataaacgtcgtatcgtgcagccgcctttcgctgagctggtgaaaagcaagttgaagctcggcggcgtcttccatatggcgaccgactgggaagcctatgccgtgcatatgctggaagttatgtcctcgctggaaggctatcgtaaccagtcggcaagcaacgattacgtaccgcgcccggaatcgcgcccggtaaccaaatttgaacagcgtggccatcgtctcggccacggcgtatgggacttaatgttcgagagggtgaaa

SEQ ID NO: 62 - DNA, 1440 bp, Klebsiella pneumoniae
gtgtcgcaatcagttctggtgctcggcgccagcggctatattggccagcatttagtgcgcgagttaagcgcgcggggctatccggtgctggcggcggcacgccatatcgaccgattgcaaaaactcgctttgcccggcgttacctgccggtcagtcgatctcaatcaaccgcaggacctgcctgcgctactcaccggtatcgataccctttattatctggtccacggcatgggcgaaggcggtgattttatcgcccatgagcggcgggtggcgacgtatgtgcgcgatgccctgcgtcagtcatcagtgcgccaggtgatatttctcagttcgctgcaggccccggcgcaggagcaatccgaccatctgcgcgctcgtcagattaccggcgatctcctgcgtgagtcgggcgtgccggtgaccgagctgcgggccgggattatcgtcggcgccggctccgccgccttcgaggtgatgcgcgacatggtttataacctgccggtgctaacccctccgcgctgggtacgttcgcgtaccacccctgtcgcgctggaaaacctgctcgttgacctggttgagctgctgaatcatccctccgatgcgcaccgcgtcttcgaagccgccggtccggaggtgttaagctatcagcagcagttcattcgctttatggccgtcagcggtaaacatcgcccgctcattcccattcccctgccgacgcgctggatctcggtgtggttcctcaatgtcatcacctcggtgccgccgaccatcgccaaggcgctgattcaggggctgaagcacgatctaatcgctgacgatcgggcgctgcgggcgctgatcccgcaaacgctgatccccttcgatcaggcggttcgccgcacgctgaaagaagaagagcagttagtaaactccagcgactggggttacgacgctcaggctttcgcccgctggcgaccggagtacggctactatccgaagcaggcaggttgcaccgtcgccactcaggcaagccgccaggccctgtggcaggtcgttaaccaaatcggcggtgaagaggggtattttttcggcaatctgctgtggaaaacccgcggcgcgatggatctgctggtcggccaccggctggccaaagggcggccgcagcgcgcttatctgcaaaccggcgatacggtcgacagctggaaggtaattatcgtggaggaagaaaaacagctcaccctgctattcggtatgaaagcgcccgggctgggccgattaagctttaccattaacgataaaggcgatcgtcgtgaactggacgtgcgcgcctggtggcacccgcacggtatgccaggcctgatctactggctgctgatgatcccggcgcacctgtttattttccgcggtatggcgcaacgcatcgcccggctggccgaacaaatctcaggcagagtcgaagga

SEQ ID NO: 63 - DNA, 1143 bp, Klebsiella pneumoniae
atgagtctgaatatgttctggtttttaccgacccatggtgatggtcgttatctgggtaccgaagagggcgcccgtccggtcgattatggctatctgcagcaaatcgcgcagacggcggatcggctgggcttcaccggcgtgctgatcccgaccggacgctcttgtgaggatgcgtggctggtcgcggcctcaatgatcccggtgacgcagcggctgaagttccttgtcgccctcaggccaagcgtggtatcgccgacggtggccgcgcgtcaggcggcgaccctggaccggctgtcaaacggccgggcgctgttcaatctggtcaccggcagcgatcctgccgaactggcaggcgacggcgtcttcctcgaccacaccgagcgctatgaggcctcggctgaatttacccacatctggcgtaagctgatggagggagaaaccgtcacctttaacggcaagcatcagcgcgttcgcgacgccaaactgctgtttccgccactgcagcagccgcgtccacccctctatttcggcggctcgtctgaggtagcgcaggagctggccgctgagcaggtcgatctttatcttacctggggagaaccgccggcccaggtggcagagaaaatagctcaggtgcgagagaaagccgcccggcatggtcgccaggtgcgttttggcatccgtctgcacgtgatcgtcagggaaaccaacgaggaagcgtggcaggcggcggacagccttatctcccatcttgacgacgagacgatcgcccgcgcccaggcggctttcgccagaaccgactccgttggccagcaaaggatggcggccctgcacaacgggcgacgcgataagctggaaatcagccccaacctgtgggctggcgtgggtttagcgcgcggcggcgccgggaccgcgctggtgggcgatgccgccaccgttgccgaaaggatcaatgaatacgccgcgctgggtatcgatagctttatcttttccggctatccgcatctggaagaggcgtaccgggtcggagagctgctgttccccctgcttgacgtcgcggtgccgtccatcccgcagccgcaaaacctgcgtctgcagggggaagcggtcgccaacgagtttattccgcgtaaagtagcgcaaagc

SEQ ID NO: 64 - DNA, 546 bp, Klebsiella pneumoniae
gtggcgttcgccggccgctccaacgcgggaaaatccagcgcgctgaatacgctgactaatcagaagaacctggcgcgtacctccaaaaccccggggcgtacgcagctgattaacctgttcgaagtcgctgagggcaagcgccttgtcgacctgcccggctatggttatgcgcaagtacccgaagagatgaagatcaagtggcagcgcgcgctgggggaatacctggaaaaacgtctatgcctgaagggtctcgtggtgctgatggacatacgtcatccgcttaaagatctcgatcagcagatgatcgaatgggcggtagagagcgatattcaggtgctggtactgctcaccaaagccgataagctcgccagcggcgcgcgtaaagcgcaagtgaatatggtgcgtgaagcggtactggccttcaatggcgatgtccaggttgaacccttctcttcgctgaaaaaatctggcgtcgataagctgcgacagaagctggatagctggtttaacgaaatcccgccgcaagaagccgtcgaagacgccgag

SEQ ID NO: 65 - DNA, 984 bp, Klebsiella pneumoniae
atgaaaacaaagacaagcttgatcctcaccgttgccgccctggcgttgtccggttccgccttagccgaagttaaaatcgcccttgtggcgaaatcgctgggaaatggcttcttcgaagccgccaacgttggcgcccaacaggcagccaaggagttaggtgatgtcaaagtgatctacaccggcccgaccactaccaccgccgaggcgcagatcgacgtgctgaacgggttgatcgcccagggggtggatgcgatcgccatttccgccaacgatccggacgcggtggtgccggtgctgaaaaaagcgatgcagcgcggcatcaaggtggtctcatgggactccggcgtggcgccggcaggccgtcagatccatcttaacccctcaaataacgccttaattggcgaaaccaacgtcaagcttgccgccgatgcgctgcaggcgctgaacgttgagaaaggcgaggtggccgtgttaagcgccaccccaacctccacgaaccagaacatctggattgaggagatgaaaaaggtgctaccgcagtatccgtcggtgcagctggtcaccgtcgcctacggtgacgatctgtcggataaaagctaccgcgaagcggtgggtctgctgaaatcatatccggacctgaaagtcattgtctcgccgtcgtcggtggggattgttgccgccgcgcaggcggtgaaggaccagggcaaaatcggcaaagtgtatgtcaccgggctggggctgccgtcggaaatggccggcgcgatcaagtccggcgccagcaaaagcttcgccatctggaacccgattgacctgggctacgccgccacctatctggccgacgatttagtcaaaggcacggcgaccaaaaccgaagccagtatgggcaagctgggcaaagtgaatctggacgccgaggggaatggcgcgatggccaagccgtttgtctacgatgcgagcaacatcgataagttctcgaaaattttc

SEQ ID NO: 66 - DNA, 438 bp, Klebsiella pneumoniae
atgctcggatgggtcattacctgtcacgatgagctggcgcaggagatgctggatcgtcttgaacaaaagtttggtccgctggcccagtgccgggcggtcaattactggcgcaatctcagcagcaatatgttgagccggatgatgtgcgatgcgctgcatgccaccgactccggggacggggtcatttttctcactgacaaaaccggtgcggcgccttatcgggccgcggcgctgatgagtcacaaacatacccactgcgaagtgatctccggcgtcagctatccactccttgagcgaatgtatctcctgcgaggcacgttaagcagcgtggcgtttcgccaggcgatcgtcagcgcgggcgggccgatggtgagcagcctgtggcatcagcagcagaagaaccccccgttccggttgcgccatgatgcctggggaaat

SEQ ID NO: 67 - DNA, 663 bp, Klebsiella pneumoniae
gtgcccgtgcagtgtaaaggtttcctgttcgatttagacgggacgctggtggattccttgccggtggtggagcgttcatggtgcaagtggggggatcgtttcgccattgaccatgatgaaattctcagttttattcacggcaagcaggccattacctccattcgccattttatgccggggcgcagcgaggaggatatccaggccgaatttcgctacctcgagcagatagaagccactgatattgagggtatcgtcgcgctgccgggggcattagccctgctgaatacgctcaatgaggccgggatcccgtgggcgattgtcacctccggctcgattccggttgcccacgcgcgtcaccgcgcggcgggcctgccgatgcctgaggtgttcgtcaccgccgagcaggtgaaacacggcaaaccggcgccggacgcctatctgctgggcgccgagcggctgggtctgcctgccggggagtgcgcggtggtggaagatgcgccggcggggctcctctccggactggcggccggctgtcgcactatcgcggtcaacgtgcccgccgatgcccctcgcctggatgaagccgacctcgtgctgagcagcctggaagatctggtggttgaacgccagactgacggcgtggtaaatgtgcgtcttaaagcg

SEQ ID NO: 68 - DNA, 687 bp, Klebsiella pneumoniae
gtggcgagtaagtttcagaaccgtttagtcgggacaatcgtgctggtggcgctgggggtgattatcctgccagggctgctggacgggcagaaaaagcattaccaggatgagtttgccgcgatcccgctggtaccgaaaccaggcgatcgcgatgaaccggatatgttgccggcggcaacccaggcgttgccttcgcaaccgccggaaggggcggcggaagaggtgcgggcgggcgatgccgccgcgccatcgttagatccatcgcgtattccggtgaacagcaacagcttcgatgacgttcaggagccggtggtggccgcgaaaccgcagcccaagccgcagccgaaaccgcagccgcaacagcaggcctcgacgccaacgccgccgccggctaagccacagcagcaacagccaccgcagcagcaggcggccctgccggcgccgaccggcaaagcctatgtggttcagctgggcgcgttgaagaacgccgataaggtgaatgagattgtcggtaaactgcgggcctcgggtttcaaagtctatacgtcgccttcgacgccggtacagggtaaaattacccgcatcctcgtcggcccggatgcgtcaaaagacaagctgaaaggccagctgggcgatctgcagcagatctccgggcttagcggggtggtgatgggcttcaccccgaac

SEQ ID NO: 69 - DNA, 771 bp, Klebsiella pneumoniae
gtggctattttgttttatcaaggaacaagcagtatgcgcaaaatcgcattatttattgcgatgcttctgttgccgtgcgtgtcatttgccgggctgctcagcagcaacagcccgacaacgccggtaagcaaagaatataagcagcaattaatgggttcaccggtttacattgagatctttaaagaagagcgcatgctcgacctttacgtcaaaatgggtgagacctaccagctcctcgacagctaccggatctgcaactactccggtggcctcggtccgaaacagcgccagggcgatttcaagagtccggaagggttctataacgtcacccgcagccagctcaaacccgacagccgcttctataaagcgattaacatcggcttcccgaacgcctacgatcgcgcccatggttatgaagggaaatacctgatgatccacggcgactgcgtctcagtcggctgctacgccatgaccgacagcggtatcgatgagatcttccagttcgtgaccggcgctttagtcttcggccagccaagcgtgcaggtgagtatctatccgttccgcatgaccaacgccaacatggaacgccacaaatactcctactacgcggatttctggaaacagctcaagcctggctatgactatttccagcagacccacaaaccgccggtcgtatcagtgaccgacggccgctatgtggtgagcaagccgctcagccacgaggttgtccagccgcagctggcctcaaactacacgctccccgagacaaaa

SEQ ID NO: 70 - DNA, 1365 bp, Klebsiella pneumoniae
atgaaggcacgagcgatattactcgcctctgtcctgctggtggggtgccaggcgtctaagcacgatggcaccgtcgaacagcgagcacagagcctttctgcggctggtcaaggggaagcaggcaagttcacaagtcaagcgcgctggttagatgatggaaccttctacgcgcaagaccaggatctgtggacttccataggcgacgagctaaagatgggaataccggataatccccggattcgcgaacagaaacagaagtacttaagaaataagagctatctccacgatgtaactttacgggcagagccgtatatgtactggatagccgggcaggttaagaaacgtaacatgccaatggaactggtattactacccatagtggagagcgcttttgacccacacgcgacgtctggcgccaatgccgcaggcatttggcagatcattccgagcacagggcgcaattatggtttaaaacagacccgcagttacgatgcgcgtcgtgatgtcgtcgcgtctactaccgcggcgctggacatgatgcaacgtctgaacaaaatgttcgacggcgactggttgttaacggtcgcagcctataacagcggcgaaggccgggtcatgaaggcagtaaaagcgaaccgttcgcgtggcaaacccaccgatttctggtcgctgtctctgccgcatgaaacgaaaatctacgtcccgaaaatgctggcattgagcgacattctcaaaaacagcaaacgttacggcgtaaagctgcctacggctgatgaaagccgtgcgctggcgcgcgttcgcctcgacagtccggttgatatttctcagctcgcggacatggccggtatgccggtcagcaagctgaagacgttcaatgcgggcgtaaaagggtcaacgctgggcgcgagcgggccaaagtacgtcatggtgccgcagaagcacgccgcacagctgcgtgaatcgctggcctctggcgacattgccgccgtgcagccgacgcagctcgcggacaatacgccgctgaccagccgtagctataaggtgcgttccggcgacaccatttccgggattgcttcccgtcttggtgtgacgacccgcgatctgcagcagtggaataacctgcgcggctctggattaaaggttgggcagaatctggttattggcgcaggcagcagcgcccagcgtctggcgaacaacagcgatagcatcacctatcgcgttcgtaaaggcgattcgctgtcgagcatcgccaaacgtcacggcgttaatattcgcgacgtgatgcgctggaacagcgataccgacaacctgcgcccaggcgatcagctaacgttgtttgtgaaaaataacgatcgaccagagtcc

SEQ ID NO: 71 - DNA, 1206 bp, Klebsiella pneumoniae
ttcagcgatacgcagacccatctccgcttcggtgcgcacgattttaccgcgcagcgagttggtgtatacatcgacgatttcgacatcgacaaacttaccgacgaggtccggggtaccttcgaagttgaccacccggttattctccgtacgtccggaaagctccatgatgttcttacgcgaggtgccttccaccaggatgcgctgtaccgtgccgagcatgcgacggctccaggccatcgcctgctggttaatgcgttcctgcaggatatacagacgctgttttttgtccgcctccggcacgtcgtcgaccatatcggccgccggggtgcccgggcgagcggagaagataaagctgtagctcatatcgaaattgacgtcggcgatgagcttcatggtcttttcgaaatcttccgtggtttcgccggggaagccgacgataaagtcggagcttatctgaatatccgggcgcgcttcacgcagcttgcgaataatcgctttatactccagcgcggtatgggtgcgtcccatcaggttcagcacacggtcggagccactctgcaccggcaggtgcaggaagctcaccagctccggcgtatcgcgataaacgtcgatgatatcgtcggtaaattcgatcgggtggctggtggtgaagcgaatgcggtcgatgccgtcgatggcggcgaccaggcgcagcaggtcggcaaagctgccggtggtgccgtcgtaattctcaccgcgccaggcgttaacgttctgccccagcagattgacctcacgcacaccctgcgccgccagctgggcgatttcaaacaggatatcgtcgcacggacggctaacttcttctccgcgggtatacggcaccacgcagtaggtgcagtatttattgcaaccttccataatcgagacaaaggcggtcggcccttcggcgcgcggctctggcaggcgatcgaatttttcaatttccgggaagctgatatcaactaccggactgcggttgccgcgcacggagttaatcatctccggcaggcggtgcagggtttgcggcccgaaaataatatcgacatagtgcgcgcgctggcgaatatggtcgccttcctgggaagccacgcagccgccgacgccaataatcaggtccgggttcttctctttcagcagcttccagcggccaagctgatggaaaactttttcctgggccttctcacgaat

SEQ ID NO: 72 - DNA, 1536 bp, Klebsiella pneumoniae
atggtatttgcctctcttcttgaacgccagcgcgtacgtctgttgctggcgctgttgtttggagccagcggaacgctggctttttcaccttatgacttctggccagcggctatcgtttcgctgatcggtctgcaggcgttaaccctcaaccgacgcccgctgcaaagcgccgggatcggctatttctggggactcgggctgttcggcacgggtatcaactgggtctatgtcagcatcgctcagtttggcggaatgcccggcccggttaacgtcttcctcgtcgttctgctggcggcctatctctcgctctacaccggcctgtttgccggcctgctcgcccgtctgtggcctaaaactaactggatacggatggctatcgctgcccctgtcgtctggcaaatcaccgagttcctgcgcggctgggtgctgaccggctttccgtggctacagttcggctacagccagattgacggccctctgaaaggcctcgcgccggtgatgggcgtcgaggcgattaacttcttgctgatggtagtcagcggcctgctggccctggccctcgtccagcgcaactggaagccgctggcgattgccgcgctgctgttcgccctgccgttcccgctgcgctatatccagtggtatcagctgctgccggcgcgcgcgacccaggtctcgctggtgcaaggcgatatcccacaggccatgaaatgggacgaaaagcagctggtcaataccctgaaaacctacctggcgctgacccagccgcatatcggccactcgcagctgattatctggcctgaatcggcgatcccggatctggagatcaaccagcagcagttcctcagcatgatggacgatctgctgcgcgcaaaagacagctcgctgatcaccggcattgtcgatgcgcgtctcaacaagcagaaccgttacgatacctacaacaccatcattactctcggcaaagataacccgtaccgctacgactcgaccaaccgctacaacaagaaccatctggtgccgttcggcgagtttgtaccgctggagtcgattctgcgtccgctggcgccgttctttgacctgccgatgtcctccttcagccgcggcccctacgtgcagccgcagctgatggcgcataacctgaagctgaccgcggccatctgctacgagataatcctcggtgaacaggtgcgggataacttccggccggacaccgacttcctgctgaccatctccaacgacgcctggttcggcaagtccatcggcccgtggcaacacttccagatggcgcgaatgcgcgccctggagctggcccgcccgctgctgcgcagcaccaacaacggcattactgcggtgatcggcccgcgcggcgagatccagaagatgatcccgcagtttacccgcgaggtgttgaccaccaccgtgacccccgccagcggcttaaccccttacgcccgcaccggcaactggccgctatgggcgctgacggcgctgtttggtttcgccgcgctgctgatgagcctgcgccagcgtcgccga

SEQ ID NO: 73 - DNA, 930 bp, Klebsiella pneumoniae
atgttgaaatttatccgcgccggcatgtatacctcggtacaggatggcggccgggaaggccagcgccagtgggggattagccgctgcggcgcgctggataaaccggcgatgaccattgccaatctgctggtgggcaatgcgccggaggcggcggcgctggaaattacgctgggtcaggtcgatgtgcagtttacccgccactgctggttcgcgttgaccggcgccgcctgtgaagcgacgctcgacggcgcgccggtctggttgggctggcgaatggaggcgaaggccgggcagcggctggtgctgaaaaatcctcagcatgggatccgcagctatctggcggtcgcgggcggtattgatgtccctgaagttttaggttcccgctctaccgatctgaaagtcggtatcggcggaatcgaagggcgccggttgcaggatggcgatcaagtgaagattgggaaatcgtcccgccgctttagctcctcgcgcggcgttaaacagctgccgataggcaatattattcgcgcgctgccggggccggagtatcacgaattcgacagcgtgtcgcaggagtctttctggcgctcgccgtggaagctgagtccgcaaagcaaccgtatggcttaccgcctgcaggggcagccgctcaggcgcacaaccgaccgggaaatgctctctcatggcctgctgcccggcgtggtacaggtaccgcataacggccagccgattgtgttgatgaacgatgcgcaaaccaccggcggctatccgcgtatagcctgcattattgaagccgatatttaccaactggcgcaaattccgctaggtcagccgatccatttcgtcccctgttcgctggaggaagcgctaaaagcgcgcgccgaccagcagcgctaccttgaacaactggcctggaggttaagcgatgaaaat

SEQ ID NO: 74 - DNA, 2280 bp, Klebsiella pneumoniae
atgagagccgcttttccagaatcctcttccctccccttccgccagcggcttctatacttacccgtttacgttgcaacggaggtgcccatgccgtggatcctgcttttgctcgctgcactgtttactgccccgctttccgccgccaccctccccggcgtgccgacggctaacactgataaaaacagcgccagcgaacccgatgtggaacagaaaagagcggcttatgccgcactggccgatgtgctggccaacgactccgcccgtcaggagctcattgaccagctgcgtaaagcagccgccacgccgccgcccgacagcaccccgacgctgacgccacctgcggtgaaagaagagaccacggtactggagaacgtcacccagataagccgggaatatggcgaacagctctcatcacgcttttcccagctgtggcgcaatatcaccggctcaccgcataagccctttaatccgcaaacctttaccagcgcggcctggcattttttactgctggccgggctggtgtttgccttctggtggctggtacgcctcgcggcgctgccgctgtatcgcaaaatgggcgaatggggacggcataaaaaccgcgatcgcggtaactggctccagctgcccctgaccatcgccggggcgtttatcatcgacctgctgctgctggcgctaaccctgtttgtcggtcagctgctaagcgatcgcctgaatgggaataaccctaccatcgccttccagcagagccttttcctcaacgccttcgcgctgatcgagttttttaaagctattctgcggctcattttctgcccgcgcattcctgccctgcggccctttaacctcagcgacgaggccgcgtcatactggagcctgcgcctgagcgcgctcagcagcctgattggttacggtctgatcgtcgcggtgccgattatttccaatcaggtgaatgttcaggttggcgcgctggctaacgtcgtcatcatgctgtgcattacgctgtgggcgctgtacctgatttttcataacaaagcggtgattactcaagggttgatccacctggccgaccactcactcgctttctttagcctgtttatccgcgccttcgcgctggtctggcactggctggcctgcgcctactttgtggtgctttttttcttttccctgttcgacccgggcaacagcctgaaattcatgatgggcgccaccctgcaaagcctggcgattatcggcggcgcggcgctggtgtctggcatcctgtcgcgctggatagccaaaaccatcaccctgtcgcccgccactcagcgcaactaccctgaactgcaaaagcggctgaatggctggatctccgcctcgctgaaggcggcgcgcattctcaccgtctgtgtcgccatcatgctgctgttgagcgcctggggcctgtttgacttccgggaatggctgcacaacgatgccgggcaaaaaacggtggatgtgctgatccgcatcgccctgatcctcttcttctccgccatcggctggacggttctggccagcctgattgaaaaccggctggcatcggatattcatggccgtccgctgcccagcgcgcgggcccggacgctgctgacgctgtttcgcaacgcgctggcggtggtgatcagcaccatcacggtgatgatcctgctctcggaaattggggtaaacattgcgccgctgctggcgggcgccggggcgttagggctggccatttcgtttggtgcgcaaaccctggtcaaagacattatcactggcatatttatccagtttgagaacgggatgaacaccggcgacctggtcaccatcggtcctttgaccggcaccgtggaacgaatgtcgattcgctccgtgggggtacgtcaggataccggcgcctatcacattattccctggtcctcgatcaccacctttgccaacttcgtgcgcggcattggctcggttgtggctaactatgacgttgaccgccatgaggatctggataaagccagccaggcgctgaaggcggcggtggacgatctgctggcccaggaggagatccgcggtctgatcattggcgaaccgtcgttcgccgggctggtggggctgagcaataccgcctttacgctacgcgtcagcttcaccaccctgccgctgaagcagtggacggtgcgttttgccctcgacacccaggtgaaaaagcacttcgaccgcgccggggttcgcgcgccggtacagacctggcagcagctgccgatgccgggcgccgacagcccggccgccgag

SEQ ID NO: 75 - DNA, 2307 bp, Klebsiella pneumoniae
atgaagaaacagcataattatacggtgatgcactggggaacctggcaggtggagagccgtgagggcgagatcgtggcggttaagccggtgccctgggataaaaatccctcacgcatcggccagtcgctccccgacgcggtgaccagccaaacgcgcattcgccgtccggcggtgcgcgccggctatctccagcacgggccggcgtcacgagaagggcgaggtaaagagccctttgtcgaagtcagctgggaggtggccctggacctgctggcgcgcgagctgcgctcggtcaaggcgcgctgcggcaatgaggcgatctacggcggctcctacggctgggccagcgctggacgctttcaccatgcgcagagccagctgcaccggtttctcaagggctttggcgggtacaccgccagcaccaatacctatagcagcgccgcgggcgagcgtattctgccgcatattctcgggccgctgagcccgctgcaccggcagcatacccatttttccgagctggctcgggagtgtcagctgtttgtcgccatcggcggactgccgctgcgcaatgcccaggtcaacggcggcggcgccaatgaccatatgctccagtactggctggataagatgcaggccaacggcacgcggtttatcaatatcagtccggtgcgcaatgacctcagcgcggtgcccgacgccgagtggctggccattcggccgggtaccgatatcgcactgctgctggccctgagctatgtgctgatcgctgagtctctctacgaccaggcgtttgttgccagccataccgtcgggtttgccccctatcgcgcttatctgttgggcgagcacgatggcgtagcgaaaaccccggcgtgggcggcggcgattaccggcctggacgcccagcgcatcgccgacctggcgcgggagatggcccgccaccggacgatggtgaatatctcctggtctatccagcgcgcccgtcaaggggagcaggcctactgggcgacggtggccctgaccgcgctgctgggacagctcggcaccccgggcggcggcctcgggtttggctacgcctgcaccaacctggcgggcgcggtgcgaaaagcgttttccggcccgcgcttacccgccggggagaatgcggtggacagcgttatcccggtggcgcggctgtccgatatgctgctgcacccgggagaaacctatgagttcgacggtcagcagcggcgctatcccgatatccgtttagtctactgggcgggaggcaatgcgtttcatcatcatcaggacatcaaccgactgtgcgaggcctggcgccgcccggagacggtggtggtgcatgagcagtactggaccgcgcaggccaaattctccgatatcgttctgccggccaccacctcgctggagcgagaggatatcggcagcggcggtcacgacgggtttatgatcgccatgagcgcgcagatcccgccggtgggcgaagcgcgtgacgattacgccattttctgcgatctggccgggcggctgggcttcggggaagcgttcagcgaagggcgtgacgccgggcagtggctacgtcatctctatgaggagtcaagaccgcgggcgcaggaggagggtattgcgctgccctcgttcgatgacttctggcagcaaggggtgctggaatacagcgcgccggagcggccgcaaatttttctcgccgattttcgcgccgatccgcagcgctatccgctctccaccccctccggcaaaattgaactcttttccgccaccgtcgccgggtttggctatcgcgaatgccctggccatccgtggtgggatgaacaggaggccgcccgccagcggcaggaggcggcgcgctggccgcttcatctgctctccagccagccgcgcgcccgcctgcacagtcagtacgaccacggcagcgtcagccgggcgacgaaagttcagggacgcgagccgctgtggatgcatccgagcgatgcgcaggcaagggatatccgcgaaggcagcgtggtgaaagtctataacgaccgcggggcaattctggcgggggtgcacctgagcgagcagattttgcccggcgtggtacagatgtccaccggcgcctggtatgacccgctggatccgaaggaagaacggtcgctcgataagcacggtaatcccaacgtattaaccgaggatcgcggcagttcgcgcctggggcagggctgtagcgcccagagctgttgggtggagatcgccccgtggcgagaggagctgccgccgatcactgcctttgatccgccgaaatttattgaagtt

SEQ ID NO: 76 - DNA, 744 bp, Klebsiella pneumoniae
atgaagtctgtatttaaagtttcactggctgcactgaccctggcttttgcggtttcttcccatgccgctaataagaccctggttgtcgccaccgatacggcgttcgtcccgttcgaatttaagcaaggcgataagtatgtgggttttgacgttgacctgtgggcggctatcgccaaagagctgaagctcgactacaccctgaagccaatggacttcagcggcattatcccggcgctgcaaaccaaaaatatcgatctggcgctggcggggatcaccattaccgacgagcgtaaaaaagcgatcgacttctccgacggctactacaaaagcggcctgctggtgatggtcaacgccaataataacgacatcaaagatgtcaaagatctgaacggtaaagtggtcgcggtgaagagcggcaccggctccgttgactacgcgaaagccaatatcaaaaccaaagatctgcgtcagttcccgaacatcgataacgcctatatggagctgggaaccggtcgcgcggatgccgtgctgcacgatacgccgaatattctgtacttcatcaaaaccgcgggcaacggtaagttcaaagcggtaggcgaatcactggaagcgcaaaactacggtatcgccttcccgaaaggcagcgacgagctgcgtgagaaagtgaacggtgcgctgaaaacgctgcgcgacaatggtacctataacgaaatttataaaaaatggttcggcactgaacccaaa

SEQ ID NO: 77 - DNA, 1263 bp, Klebsiella pneumoniae
atggctgctctcccgacccacgaaacacttcccgccgatcacaaagcggcgattcgccagatgaaacaggccctgcgggcgcaaattggcgacgtccaggcggtgttcgataagctctcagcgcgcatcagcgagcggctgcaggagattgagacactgaaagccgcaggccaggaggtttggccaaccgttccgttccgcgatatcgccgaaggaacagtgagcgatgagcagcgcgcggccattaagcgccggggctgcgcggtgattaaaggccacttcccacgcgaacaggcgctggcgtgggataccgcgatgctggaatatctggatcgcaaccatttcgacgatgtttacaaagggcctggcgacagcttcttcggttcgctggaggcttcgcgcccggagatctacccgatctactggtcgccctcgcaaatgcaggcgcggcagagcgatgaaatggcggcagtgcaatctttcctcaaccgcctgtggcgttttgaacagaatggcaaacgctggttcgatccggacgtcagcgtaatctatcccgaccgcatccgccgccgcccgccgggaaccacttcgaaggggctgggggcgcataccgattccggcgcgctggagcgctggctgcttcccgcctatcagcaggttttcgccaacgtttttaatggcaatatcgacgcctacgacccgtgggacgccgcgcaccgtaccgaagtggaagagtataccgtcgacaacaccaccaaatgctcggtgttccgcaccttccagggctggaccgcgctgtcggacatgatcccgggtcaggggctgctgcacgtggtgccgatcccggaggcgatggcttatgtgctactgcgccccctgctcgacgatgtgccggaagatgagctgtgcggcgtcgcgccgggcagagtgctgccgatctctgagcagtggcacccgctcttaattaaagcgttaagctcgattccagcgctgaatgccggggactccgtctggtggcactgcgacatcattcactcggtggcgccggtggaaaatcagcagggctggggaaatgtgatgtacattccggccgcgccgatgtgcgagaagaacctcgcctacgcgcagaaagtaaaaatcgccctggaaaaaggcgcctcgccgggggatttcccgcgcgaggactatgaagccagctggcaggggcgcttcaccctggaggatctgaatatccacggcaaacgggcgctgggtatgccggtc

SEQ ID NO: 78 - DNA, 969 bp, Klebsiella pneumoniae
atggcagattttccccctgtcgccagcctgcgcagctttgaggcggtggcgcgcctcggcagcgtaacgcaggccgcccacgagatgagcgtgacccattcggcggtcagccagcacatcaaacagctggaagccctggtcggcgtcacgctctttatccgccacggccgcggagtgcgcatcacggaagaaggacggctctatgccctgcaaatccgcgaggcgttacagcacatcgccgacgccacgcgcatggtgcagatcaaaccccgcaccctggaagtgaccctggcgacgatcccctcctttggctgccactggctgctgccgcggctggcgcgctttcaggcgcggcatccgcagatcgcggtgcgcctgctgaccagcctggcggtggttaacctgcaacaggagggtatcgatctggccattcgcatggggcaaggcgattgggagggaatggaaagtcggcatctgtttgccgatgaacagctggtggtcgccgcccccggctatcgcggcggtaacctgccgaccaccccgcaggcgatcgccgccagcgatattattttttccatggagtcctggcatgcctggtgcagccaggcggggctggaaaagccgatcgtccccgcaggcctgcgcctgaacgactccaatctggtgctggaggcggtccgcctgggggccggcgtggcgctggagcggcgctccctggtggcgggggcgatagcccgcggcgagctggtgcagctcaccgccgtcaccgtcccctacccctggcactactggctaaccgtctccccgcaggcggagaaccggccggaagtcgcccggttcatcgcctggctggaggaggagatcgccctctggcgccagcagatcagcgcttaccttcgccgacggcggcaggccgtccgggcggcgtgctcctgggagagacgccagaaatcgtgcccggcgggatac

SEQ ID NO: 79 - DNA, 663 bp, Klebsiella pneumoniae
atgcgtaatcagccgctgggcaatctcgccgccggcgccgttgaccacgttaatcaccccatccgggatacccaccgcttttgccagctccgccacgcgcagcagcgtcagcggcgtatattcgctcggcttgaggacgatggtgcagccgcagaccagggccgccgccagcttccagatggcaatcatgatggagaagttccacggcacgatgccaaccaccacccccagcggctggcggcgggtaaaggcggtatatttctccccggccatcgatggcagcgagacatccagcgtttcaccggtgactttccccgcccagccggcgaagtagcgcaggaacgccaccgactggtccagctcgagcatccgcgccagcgtgatagttttgccggaacagagactttccagctgcgccagcgcttcgcgatgctctgccagcgtgtccgccagcttcagcagcagcgcgccgcgcgccagcgtcggcatctcgcgccactgactaaacgcctggcgggcgctctccatagcgcgatccgcctggtcactatccgccgcggtgacctcggcaatcgcccgcccggtcgccgggttgatcaccgcgaacggcgcgccgcggcccgcctcacgttgaccggcaataaactgcccgtgcggctggcg

SEQ ID NO: 80 - DNA, 1005 bp, Klebsiella pneumoniae
atgcggttcatctggctctatacggaattgaaaaacgctcccacattaaaaacgtattcagccgccgtggactggaacgtccccggccactattttgcagaaaccttttcgcgttctggaatgaacccgtctggccaatccatcaggggtgaaataatgaaaaaatcattggcatcaatgtgtctgagcgctgtattaacggtcgctttttcttatcacgccgtcgcggccgatcttccggaaatagaaaaatccggcaccttgaaagtggcgacggaagatgattatgcgccgtttaactttatgaataatggccaggctgatggctttaacaaagatatgcttgaggaattacgtaagtacgcaaaattccatgtcgaccagagcatattaccgtggaccggattattagcggctgtctccaccgggcaatacgatatggccttaaccggggcggttattaccgatgagcggctgaaggtctttgatttcaccccaccgtgggcctccgcgcagcactatttcgtcaaacgcgctggcgatacctcgctaaataccattgccgatctcagcggcaaaaaagtgggggtacaggccgggagcgcgctgctggcgcgtttgccggagctgaaggcgatgctggagaagaccggcggcaagctggggccggtggtggagtatccctcctatccggaagcctacgccgacctggcgaacaagcgactggattacgtgattaacgtggtgatctcggtaaacgacctggcgaaagccaaaccgaaggtcttcgccaaagggctggccgtctccggaccggggtatatggcgtggccgatcccgaaaaactcgccgcagctgctggcctatatgaccaggtttatgaaccacatgaaggagaccggcaagctcgccgaactgcagaaaaaatggttcggcgaaacctatgacaacctgccgaccgaggcgatcaccagcccggaacagtttcacaaactcgccggactg

SEQ ID NO: 81 - DNA, 1899 bp, Klebsiella pneumoniae
atgaaattacagaattctttccgcgactatacggctgaatcctcgctgttcgtgcgccgggcgctggtcgcttttttggggattttgctgcttaccggcgttctgatcgccaacctgtacaatgtgcaaatcgttcgcttcgacgactatcagacgcgctcgaacgaaaaccgcatcaagctggtgccgatcccgccgagccgcggcattatttacgatcgcaacggcaccccgctggcgcttaaccgcaccatttaccagctggagatgatgccggagaaagtcgataacgtacagcagacgctggatgcgctacgcgacgtcgtcgatttaaccgacgatgacatcgccggtttcaaaaaggagcgcgcccgctcccatcgttttacctcgattccggtaaaggtcaacctcagcgaagtgcaggtggcccgctttgccgtcaaccagtaccgctttcccggcgtggaagtcaaaggctacaagcgtcgttattacccctataattcggcgctgactcacgtcattggctatgtctcaaaaattaacgataaagacgtcgaccgcctggataaagagggcaagctggccaactacgcctcgacgcacgacattggtaagctgggtatagagcgttattacgaggacgttctgcacggtcagaccggctacgaagaggttgaagtgaacaaccgcggccgcgtcattcgtcagctgaaagaggtgcctccgcaggccggacgcgacatttacctcaccctcgacctcaagctgcagcagtatattgaaacgctgctggccggcagccgcgccgccgtggtggtgaccgacccgcgtaccggcgctattctggcgctggtttcaaccccgagctatgacccgaacctgttcgtcgacggcatctccagcaaagattactccgcgctgctcaacgacccgaacacaccgctggtcaaccgagcgacgcagggggtctatccgccggcgtcgacggtcaaaccgtacgtcgccgtctcggcgctgagcgccggggtgatcacccgcaacaccagcctcttcgaccccggctggtggcagttgcctggctcagagaaacgctatcgtgactggaaaaagtggggccacggccatctgaacgtcaccaaagcgctcgaggagtctgcagatacctatttctaccaggtcgcctatgacatgggcatcgaccgtctctcagagtggatgagcaagtttggctacggccactacaccggtatcgacctctccgaggagcgctctggcaacatgccgacccgcgaatggaagctcaagcgctttaagaaaccctggtaccagggggacaccattccggtgggcatcggccagggttactggaccgccacgccgatccagatgaacaaagcgctgatgatcctgattaacgacggcgtggtgaaggtgcctcatctgctgcagagcaccgtggaagacggcaagcccgtaccctgggtccagccccatgagccgccggtaggcgatatccattccggctattgggaaatcgccaaagacggcatgtacggcgtggccaaccgcggcaacggcaccgcgcacaaatacttcgccagcgcgccgtataaaatcgcggccaagtcaggtaccgctcaggtgttcggcctgaaggccaacgaaacctataacgcgcaccggatctccgagcgcttgcgcgaccataaactgatgacagcgtttgcgccttataacaacccgcaggttgccgtggcgatgattctggaaaacggcggcgccggcccggcggtcggtacgattatgcgccagatcctcgatcacatcatgctgggcgataacaacactacgctgccaagcgaaaacccggcggtaaccgcaggggaggatcaa

SEQ ID NO: 82 - DNA, 2226 bp, Klebsiella pneumoniae
atgaataacaggatcaaatccctggccttgctggtcaatctgggaatttacggggttgcttttccgttaagcgcagcggaaaccgccaccgacgataaaaacagcgccgctgaagagaccatggtggtcaccgccgccgagcagaacctgcaggcgccgggcgtctccaccatcaccgccgatgagatccgcaaacgccccccggcgcgcgacgtctcggagatcattcgcaccatgccgggagtcaacctgaccggcaactccaccagcggccagcgcggcaacaaccgccagattgatatccgcggcatgggcccggaaaataccctgatcctgatcgacggcaagccggtcaccagccgcaactccgtgcgccttggctggcgcggcgagcgcgacacccgcggcgataccagctgggtgccgccggagatgatcgaacgcatcgaagtgattcgcggcccggccgccgcccgctacggcaacggcgccgccggcggcgtggtgaatatcatcaccaaaaaaaccggcgatgagtggcacggctcatggaacacctatatgaacgccccggagcacaaggatgaaggctccaccaaacgcactaacttcagcctcagcggcccgctgggcggcgattttagcttccgcctgttcggtaacctcgacaaaacgcaggccgacgcctgggatatcaaccagggccatcagtccgagcgtaccgggatctatgccgatactctgccggccgggcgcgaaggggtgaaaaacaaaaacatcgatggtctggtgcgctgggaattcgctccgatgcagtcgctggagtttgaggccggctacagccgccagggcaacctctacgccggcgacacccagaacaccaactccaacgacctggtaaaagagaactacggcaaagagaccaaccgtctgtatcgcaacacctactcggttacctggaacggcgcctgggacaacggggtgaccaccagcaactgggcgcagtacgaacgcacccgcaactcgcgcaaaggcgaaggcctggccggcggcaccgaggggatctttaacagcaaccagttcacggatatcgatctggcggatgtgatgctgcacagcgaagtcagcattcccttcgactatctggttaatcagaacctgacgctgggcagcgagtggaatcaacagcggatgaaggataacgcgtccaacacccaggcgctgtcgggaggcgaaattccgggctacgacagcaccggccgcagcccgtactcgcaggcggaaatcttctcgctgttcgccgagaacaacatggagctgaccgacaccaccatgctgactccggcgctgcgtttcgatcatcacagcattgtcggcaataactggagcccgtccctcaacctgtcgcagggcctgtgggatgacttcacgctgaagatgggcatcgcccgcgcctataaagcgccgagcctgtatcagaccaacccgaactacattctctacagtaaaggccagggctgctacgccagtaaagacggctgctatctgcagggtaatgacgacttaaaagccgagaccagcatcaacaaagagattggcctcgagtttaaacgcgacggctggctggcgggcgtcacctggttccgcaacgactaccgcaacaagattgaagcgggctatgccccggtctatcaaaacaataaaggtaccgatctctaccagtgggaaaacgtgccgaaagcggtggtggaaggtctggaggggacgttgaacgttccggtgagcgagaccgtcaactggaccaacaacatcacctatatgctgcagagtaagaacaaagagaccggcgatcgtctgtcgattatcccggaatacacgctgaactccaccctgagctggcaggttcgcgatgacgtttcgctgcagtcgaccttcacctggtacggcaagcaggagccgaagaagtacaactacaagggtcaaccggtcaccggcagcgagaagaacgaggttagcccctacagcatcctcggcctgagcgcgacctgggacgtcaccaaatacgtcagtctgaccggcggcgtggataacgtcttcgataagcgccactggcgcgcgggcaacgcccagaccaccgggggcgccaccggcacgatgtacggcgccggcgccgagacctacaatgaatcgggccgcacctggtacctgagcgtcaacacccacttc

SEQ ID NO: 83 - DNA, 609 bp, Klebsiella pneumoniae
acgcaggtcgcgaaacgcgtcccccagttcacggccgtcatactccaccacctccagcgcacgaccgacgtcgactgcgccgggttcatccggatagtaatcgggcgagagcggacgcaggctgtactttactgccccctcacgctcgagaaaggccagcacctcccgcccggcgctgacaaacgcttcggcaagatcttctcggtactggccctcgccgataatggttcgcaggtaggttttcatcgcctcggcgctaccgcttttgccctcggcgcgcgcctggtcggtatcgtgcagccacacggcgccgccggagatggccgaggtgccgccgaactggccggctttctccagcatcagcaccgacagccctttacagcaggcggtgaccgcggcggcaaaaccggccgcgccgctgccgatgacgatcacatcccagctcttcatgccgccgctccctgcgcctgcgggatggcgccgataaactggcccatcagcctcatctgcgccagcgccatttccggcccggtctgtactttacaaccacgtgcggcggcgaaagtgagcaacggcgtcatcaccggggcggtgacaacgtcggccaca

SEQ ID NO: 84 - DNA, 939 bp, Klebsiella pneumoniae
atgaggggtgtgatacagcagacattatgccagcaaatgacacacttttcacggcctgcggtaaattccaccgcggcgcttgtgctaaggtctttgtcagatgagccggaaacccgcgctcaaacggttattctgtacgtatttataaggagtcccatgaccagcagcctatcgcgacacccggcttttttatccctgcagggcggcatcaattttcgcgacctgggcggccagcttgccgccgacggacgccgcgtccgcagcggcaagctattgcgatccggcgcgctaaaccggttaacggcggaggatctcaaccacctcgatactttgccgctcagccgggtgctcgactatcgcgaccccggagaggtagcccgtactccggacaagcttagcccgcttacccattatcttaacgcgccggccaatccgccggtgagcgaggtaaatgcgaaggtcaccgagctgaatgccgccacccttaacgcgctgaacggcgagcagtttatgctgcaactctaccgccagctgccgtttaacaacccggcctatcgccagctcgccgcctggctgaccacgccttttgaaggcgctttactgcaacactgcgcggtcggcaaagatcgcaccggcgtcggctgcgcgttaacgctgttcgccgtcggctgcgacagcgaaacggtgatggaggagtatctccttacccacggcatgctgacgcaggtggaggcctggatgttggagctgctcggcaacgacctcactgcccaggggcgccaaagcctggcggatattctgacggtaaaagagtcctatctcgccgccgcgctgtcggctattcaccagcgctatggcaccgtcgacgcctggctggcggcagagtaccagcttacggcgccggttcgcgccgcgctgcaggcccggctgctggaagag

SEQ ID NO: 85 - DNA, 1419 bp, Klebsiella pneumoniae
atgatttcagcacgttggcgctgttctgggtgggtaccggtctgggttccgcgctactctgttttaccactgccgccatcgtcgcccggcgccatgccgtcgaacggcagacctcgttctcctcataaccgattaacgaataaggaagaagatatgatgcctgcaagacatcaggggctgttacgcctgtttatcgcctgcgcgctgccgctgctggcgctgcaatctgccgccgccgcggactggcagctggagaaagtggtcgagctcagccgccacggtattcgtccgccgacggccggcaaccgggaagccatcgaggccgccaccggccgaccgtggaccgagtggaccacccatgacggggagctcaccggccatggctatgccgccgtggtcaacaaagggcgtgcggaaggccagcattaccgccagctcggcctgctgcaggccggatgcccgacggcggagtcgatatacgtgcgcgccagcccgctgcagcgtacgcgagcgaccgcccaggcgctggtggatggcgccttccccggctgcggcgtcgctatccattatgtcagcggggatgccgatcccctgtttcagaccgacaagttcgccgccacgcaaaccgaccccgcccgccagctggcggcggtgaaagagaaggccggggatctggcgcagcgtcggcaggcgctggcgccgaccatccagctattgaaacaggcggtttgtcaggccgataagtcctgcccgatcttcgataccccgtggcaggtcgagcagagcaaaagtgggaagaccaccattagcggactgagcgtgatggccaatatggtggagacgctgcgtctcggctggagtgaaaacctgcctctcagccagctggcgtggggcaagatcacccaggccaggcagatcaccgccctgctgccgctgttaacggaaaactacgatctgagtaacgatgtgttgtataccgcgcaaaaacgcgggtcggtgctgctcaacgctatgctcgatggcgtcaaaccggaggcgaatccgaacgtacgctggctgctgctggtggcccatgacaccaatatcgccatggtgcgcacgctgatgaactttagctggcagctgccgggctacagccggggaaatatcccgccgggcagtagcctggtgctggagcgctggcgcaacgcgaagagcggagaacgctatctgcgggtctatttccaggcccagggcctcgacgacctgcgtcgtctgcagacgccggacgcgcagcacccgatgctgcgtcaggagtggcatcagccgggctgccgtcagaccgacgtcggtacgctgtgtcccttccaggcggctattaccgccctcggtcagcgtatcgaccgatcatccgccccggcggtagccatggtcctgccg

SEQ ID NO: 86 - DNA, 3090 bp, Klebsiella pneumoniae
atgctgaccttttttatccgtcgtccgcgatttgccatggtgatcgcgctgctgctgacctttgtcggcgcggtgtcgctgaagctgatcccggtggagcagtacccggcgatcacccccccggtggtgaacgtcagcgccagctggccgggcgccagcgcgtcagacgtggcggaagccatcgccgccccgctggagacccagctcaacggcgtcgatcatatgctgtatatggagtccaccagctcggatgaggggacgtaccgcctgagcataaccttcgcggcgggcaccgatgccgacctggcggcgatcgacgtgcaaaaccgggtggcgcaggcgctggcgcagctcccggcggaggtgcagcagaatggcgtccaggtgcgcaagcgcgccagcaatctgcttatgggggtaagcctctactcgccgctgggcacgctgtcgccgctgtttgtcagcaactacgccagcacccaggtgcgcgaggcgctggcccgcctgcccggcgtcggcgaggtgcagatgtttggcgcccgggattacagtatgcgcatctggctgcgcccggaccgcatgaacgcgctcaacatcaccacggatgatgtcgcccaggcgctgcgcgagcagaatgtgcagggcgcggcggggcaggtgggcaccccgccggtatttaacggccagcagcagacgctgaccatcaacgggctggggcgtctgaacgaggcggccagctttggcgagattattatccgccgcggcgcgcaggggcagctggtgcgcctcgccgacgtagcgaccattgagctgggcgcccgcagctacagctccggcgcccagctgaacggtaaagcgtcggcctatctggggatctatccgacgcccaccgccaacgccctgcaggtcgccagcgcagtgcgtgcggagcttaaccgcctgcacactcgctttccggcggatctcacctgggaggtgaagttcgataccacccgctttgtggcggcgacgatcaaagagatcggcgtctcgctggcgctgaccctgctggcggtggtcgtggtggtgtcgctatttttgcagagctggcgggcgacgctgatcgtagtgctggcgatcccggtgtcactgatcggcacctttgcggtgctctatctgctgggctacagcgccaacaccctcagcctgttcgcgatcattctcgccctgacgatggtggtggatgacgccattgtggtggtggagaatgtggaaaccaaaatggcggaagggctggatcgcctgcaggccaccgcccaggcgctgcggcagatcgccgggccggtgatcgccacgaccctggtgctgctggcggtgtttgtgccggtggcgctgctcccggggatcgtcggcgagctgtaccggcagtttgccgtgacgctctccaccgcggtggccctgtcgagcctggtggcgctaaccctgacgccggccctctgcgcgctgctgctgcgcccgcgtcctgcccggccggcggcggtgtggcgggcgtttaaccgtcttctcgacggcacccgcgacggctatggccggctggtaggctggatgaaccgccgtccctggctggcgctggcggcgacggtggcggcaggcgcgctggtggcgttcagcttcacctcgatgccgaaaggcttcctgccgcaggaagatcagggttacctgtttgccagcgtgcagctgccggaggcggcgtcgctggagcgtaccgaagcggtgatggcccaggcgcgtaaactgctgatggctaacccggcggtggaggatgtgattcaggtgtccgggttcaacattctcaacggcaccagcgcctctaacggcgggtttatctcggtaatgctcaaggactggcatcagcggccgccgctggatgcggtgatggcggatattcagcgccagctgctgtcgctaccggaggcgacgatcatgaccttcgcgccgccgaccctgccgggcctgggcaatgcctcggggtttgatctgcgcatcctggcgcaggccggtcagtcgtcggcggagctggagcaggtgacgcgggagatcctccagctggcgaaccagtatccgcagctgagccgggtgtttaccacctggagcagcaacgtgccgcagctgaccctgacggtccaccgcgaccgggcggcgctgctggatgtgccggtggcgcagatcttcagcagcctgcagacggcgttcggcggcacgcgcgccggcgatttcagccgtaacaatcgtgtctatcatgtggtgatgcaaaatgagatgcagtggcgcgagcgggcagagcagattagcgagctgtacgtccgcagccgcgacggcgagcgggtgcggctgagcaatctggtcaccattacgccgacggtgggggcgccgtttattcagcagtacaatcagttcccgtccgtgtcggtgagcggttcagcggccgagggggtcagcagccgcacggcgatggcggccatggagcagattttgcaggcccatctgccgccgggatatgactatgcctggagcgggatctcctggcaggagcagcagaccggcaatcaggcggtgtggatcgtgctggcggcggtggcgatggcgtggctgttcctggtggcgcagtatgagagctggacgctgccggcgagcgtcatgctctcggtgctgttcgccatcggcggagcgctgctctggctgtggaccgcgggctatgccaacgatgtgtatgttcagatagggctggtgctgctgatcgccctggcggcgaagaatgcgattctgatcgttgagttcgcccgcagccggcgcgaggaggggctgtcgatagtcgacgctgcgcgcgagggggctacccgccgcttccgcgcggtaatgatgaccgcggtgtcgtttattatcggcattatgccgatgatgctcgccaccggcgccggggcgcagagccggcggatcatcggcaccacggtattcagcgggatgctggtggcgacgatggttggcatcctgtttatcccgtcgctgtatgtactgtttcagcgtatgcgcgagtgggcgcatcggcggggg

SEQ ID NO: 87 - DNA, 933 bp, Klebsiella pneumoniae
gtgcggcgcgctgctgctggcgctggccgattacggcgcccaacggctgtttatgccgtggcagctgccggttggcgtgttaaccgtcagcctcggcggtatttaccttattgcattgttgattcaggagtcccgcaaaaaatgagtgctgtcccctcccgtttgcgcggcgagcagttaaccctggcctacgggaacaagaccatcgccgagtcgctgaacgtgaccatccctgacggtcacttcaccgccattatcggccccaacggctgcggcaagtcgacgctattgcgcaccctcagtcgcctgatgacgcccgccagcggccacgtctggctcgacggcgcgcagatccagcagtacgccagtaaagaggttgcccgccgcatcgggctgctggcgcagaatgccaccacccctggcgatatcacggtgcaggagctggtggcccgcgggcgctatccgcaccagccgctgtttacccgctggcgcaaagaagatgaagaggcggtgaacaaggcgatgcgggcgaccgggatcagcgatctggcgctgcagagcgtcgacacgctttccggcggccagcggcagcgggcgtggattgcgatggtgctggcccaggaaacggcgattatgctgctggatgagccgaccacctggctggacatcagccatcagatcgacctgctggaactgttgagcgagctgaatcgcgagaagggctataccctggcggcggtgctgcacgatcttaaccaggcctgccgctacgccacccacctgatcgccctgcgcgacggcaggatcgtcgccgagggggcgccgaaggagatcgtcaccgccgatctgattgaacggatttacggtctgcgctgcacgatcattgaagatccggtggcgcatacgccgctggtggtcccgctgggccgccgg

SEQ ID NO: 88 - DNA, 2454 bp, Klebsiella pneumoniae
gtgtggaatacatccccatatactggattacatattaacgacgatgcagtggagtgtggcgtcgtcggctacctggcggactttaaactaagagagagctctatgaatcctgagcgttctgaacgcattgaaatccccgtattgccattgcgcgatgtggtggtttatccgcacatggtcatacccctgttcgtagggcgggaaaaatctatccgttgcctcgaagcggccatggaccatgataaaaaaatcatgctggttgcgcagaaagaagcgtcgacggatgagccgggtgtaaacgatcttttcaccgttggaaccgtggcgtctattttgcagatgctgaagctgccggacggcaccgtgaaggtgctggtcgaagggctgcagcgtgctcgcatttctgcgctgtctgataatggcgagcatttctcggcgaaagcggagtatctcgactcgccggcgattgacgaacgcgagcaggaagtgctggttcgcaccgctatcagccagtttgaaggctatatcaagctgaacaagaagatcccaccggaagtgctgacgtcgctgaacagcatcgacgatccggcgcgcctggcggataccatcgcggcgcacatgccgctgaagctggctgacaagcagtctgtgcttgagatgtccgacgttaacgaacgtctggaatatctgatggcgatgatggaatcggaaatcgatctgctgcaggttgagaagcgcattcgcaaccgcgtcaaaaagcagatggagaaatcccagcgcgagtactatctgaacgagcaaatgaaagcgattcagaaagaactcggcgagatggacgacgccccggacgaaaacgaagcgctgaagcgtaagatcgacgcggcgaaaatgccgaaagaggcgaaagaaaaaaccgaagcggaactgcagaagctgaagatgatgtcgccgatgtctgcggaagcgaccgtcgtgcgtggctacatcgactggatggtgcaggtgccgtggaatgcgcgcagtaaggtcaaaaaagacctgcgtcaggcccaggagatcctcgataccgatcactatggcctggagcgcgtgaaggatcgcatccttgaatatctcgcggtgcagagccgggtgaacaaaatcaaggggccaatcctttgtctggtgggaccgccgggggtaggtaaaacctcgctgggtcaatccatcgccaaagcgaccggacggaaatacgttcgtatggcgcttggcggcgtgcgcgatgaagcggaaatccgcggtcatcgtcggacctacattggctcgatgccgggcaaactgatccagaaaatggcgaaagtgggtgtcaaaaacccgctgttcctgttggacgagatcgacaaaatgtcttccgacatgcgcggcgatccggcttccgcgttgcttgaggtgctggatccggaacagaacgtggcctttaacgaccactacctggaagtggattacgatctcagcgacgtgatgttcgtggcgacttccaactccatgaacattccggcgccgctgctggaccgtatggaagtgattcgtctctccggctataccgaagatgaaaaactgaacatcgccaaacgtcatctgctgccgaagcagatcgaacgtaacgcgctgaagaaaggcgagctgaccgtcgacgatagcgccattatcggcattattcgttactacacgcgggaagcgggggtacgtagcctggagcgtgaaatctccaagctgtgccgcaaggccgttaagcaactgctgctggataaatcgctgaaacacatcgaaattaacggtgagaatctgcatgattatctcggcgtacagcgcttcgactatggccgcgccgatagtgagaaccgcgtcggtcaggtgaccggtctggcgtggacggaagtgggcggcgatctgctgaccatcgaaaccgcctgcgtgccgggcaaaggcaagctgacctacaccggctcgcttggcgaggtgatgcaggagtcgattcaggctgcgctgacggtggtacgttcgcgggctgacaagctgggcattaacgccgacttctacgagaagcgtgacattcacgtgcacgtgccggaaggggcgacgcctaaggatggtccgagcgcgggtattgccatgtgcacggcgctggtctcctgcctgaccggcaacccggtacgcgctgatgtggcgatgaccggtgaaatcactctgcgtggtcaggtgctgccgatcggcggtctgaaggaaaaactgctggcggcgcatcgcggcggcattaagactgttctgattcctgatgagaacaaacgcgaccttgaagaaattccggataacgttatcgccgatttggatatccatccggtgaaacgaatcgaggaagttctgacacttgcgctgcagaacgaaccgttcggcatgcaggttgtgaccgcgaaa

SEQ ID NO: 89 - DNA, 930 bp, Klebsiella pneumoniae
atgcagttacagaaattagtcaatatgtttggtggggatcttatgcgtcgctatggcgaaaaggtccataagctaacgctgcacggcggttttagctgcccaaaccgcgacggcacgctgggccgcggcggttgcactttctgtaacgtggcatcgtttgccgatgaggcgcagcagcatcgctctatcgccgaacagctcgctcatcaggcgcagctcgtcaaccgggcgaagcgctatctggcctattttcaggcctacaccagcaccttcgctgaagtgcaggtgctccgttcaatgtatcgtcaggccgtcagtgccgcaaatatcgttggcctgtgcgtcggcacccgcccggactgcgttccgcaggcggtccttgacctgctgagtgaataccatcagcaagggtatgaggtatggctggagctggggctgcaaactgctcatgataagaccctgcatcgcattaaccgtggacacgatttcgcctgttatcagcgtaccgcgcgcctggcgcgagagcgggggctgaaagtctgtacgcatctgatcgtcggtctgcccggagagagccaggggcattgtctgcagacgctggagcaggtagtggcgaccggcgtggatgggatcaaattgcatccactgcatattgtgaaaggcagcattatggccaaagcgtggcaggccgggcgtctcgatggcattgagctggaggcgtataccgtcaccgctggagagatgatccgccatacgccgccggaggtgatctaccaccgtatttccgccagcgcccgtcggcccacgctgttggcgccgctgtggtgtgaaaatcgctggaccggcatggttgaactggatcgttatctgaatcagcagggcgctcagggctcggcgctgggccgtagctgggttgctccccaggctgag

SEQ ID NO: 90 - DNA, 921 bp, Klebsiella pneumoniae
atgaacaaaatcattgaaaatgattttagtcgtatcgatctgaatctgttgacagtcttgatggtgctgtaccgcgaagggagcgtcacccgcaccgcagaggtactgcatcttggccagccggctatcagcggggcgctgaaacggctgcgcgagatgtttgacgacccgctgttcgtccgcagcgccagaggcatgctgccgacgccgcgggcgcaagcgctgatgaccgacctgcagccgctgatggaaaaccttcattcggcgatgtttggcgccggagagttcgtcccggcgcgcgcgcagcagctttttcgcatcggcctcagcgactggagcgaacactggctgatgcccccgctgttacccgggctgatgcaggaggcgcccggagtgtcactgcagtcgatagccgccgaccccttccaggttcgccagttgctggaggaggagcgcattgatgtcgcggtgtctgtcaacaaacagagccgcggggaggtggtcagcgagccagtgatgaccatgggagtcaccaccctgtggtcgccgcagcagatcccctgccgcgggccgctgtcggtgagcgactttgtcgcctgggaacacgtgatggtggcctatcgcgaaaccggccacggtgaaattgaccgccagctcgccagccagggactcgcgcggcgcgtgcgctttgccacgcagaatttctccacctttcccctgctgctgaccaccctgccgctgttcgccaccgtcccgcaggggctggcgcagcgctggcaggcgcagtatgcgctgcgcgcggacgctccgccggtagcgtatccggaatttacgctgtgcattttgcggcacaaacggcgggcgcaggatccggcgctgaactggctggtgacgaagttaaaacaggccatgcgcggccaa

SEQ ID NO: 91 - DNA, 2430 bp, Klebsiella pneumoniae
atgctgatagatcgggacggcattcgcctgatgggtgagcgaaaaggtcagcaggctaccagccaggcgcgccagctccgggtagaggcgttccggcgggctttgccggtaacgcagaaagtaccccagcaccggctcggcgctgttcagcgcattcagcaaccagaacagagagacatcggctacggcaaaatcagccatccgttcattgctttcgcgacgcatggccatcaggcgcgtcagacgagcccggagctggacgagcagctgttcaagctgcctcgccagccagcggctgccctggatctgcagcagcggcgggagaaacgtctcgtcgataagccaggccccctgcgagtcccgctgcaggcgaacaagcggacaggtcaggtaatcgctgttgtcctggtgggcgaagcggaggatcagctccggctgtatgacggcaatctgccgggtatcatccccaaactggttacggacatcgcgccagcgctgccggaagcgcaccggcctttcggccacctcctccggcttcagacagttgccgccattcgcctgcatcaggggcagcgccagcacgatcaccgcctcgccggacgcgccgtccagcgacagcgcggacggcagcgcatcggcattgtccgtatcaatcatcgtgccatcctggaaccggacctgcagcctgtgagcctgcaggcggcccagtttgagcatctctggttcgaaggtcgcctcaaccactccccaggggtggttaagacccatccgggcaatcacttccgcagtccaggctgcatacgcagcctgctgttgaaaatgctgaggcgacaccataatgccccggccccacaacggacgttccgttttcatcatcgtccgaacctacgccttcgcctttggcatctggctaaccagcgacagattgacgtccatcccctcgacctggaagtgcggcaccgcgtacagcttcacgcggaagaagcccgggttatcctcgatatcttccaccaccacgctggcatcgcgcagcggatgggaggcctgcagctcgtcgccggggtcggtcatttcggtcaccaggctccgcacccaggtgttcagctccagctccagcagacgccggtccttggtggtgccgatattttcgcgctggatcatcttcaggtagtgcgcgatgcgcgacagcaggaagatgtaaggcagacgcgcgttgatacggctgttggcggtggcgtcggcggtatcgtacagcgccggtttctgcgcggagttggccgagaagaagcaggcgtaatcgcgatttttgtagtacgacagcgggataaagcccaggctggcgaactcaaactcccgcgtttccgggatcatcacctcggaagggatcttcacctggttgccggtgcccagatcgtacagatggataggcaaatctttcaccgcgccgcccgcctgcggaccgcgaatttgcacgcaccagccgttgttaacaaagctcttcaccatattagatgcgaaggagaacgccgcgctggtccagagatatttttcgtgatccgggcccttcacctgctcgacatagttgaagctgcgcaccggcacggtgtccggaccgtacggcagacgacccagcacgcgcggcatcaccaggccgatgtagcgggcatcgtcagtttcgcgaaacgccttccagcggatatattccgcacgatcgaagtagttgccgatatccttaatggcagccacctcttccatggtctctttcaggaagaaggccgggccgacggcgccgataaacggcatatgggcggccgcagagacgcgggagatattgcgcagcagcgccacatcctgcgggctggcgtcgaactcataggccgagatcaccgagccgatcggctcgccgccgggagtgtcatactccgcggtataggtgtgccagtacaggccgctctggataagctccggcgcgtcctcaaagtcctggcgcagatcgtctttggcgacgtcgaggatctccgttttgacgttctgccgatagtcggtgttgtccaccagctgtttgaggccgcgccacagggattcgacctgctgaaactcctgatggtgcatcaccgcgtccagctgacggcttatctggaaatccagctcggcgatatggtggtcgatcagcgttttgtcgagcttttccacccgctggccggactgacggatgcgttccataaacacctgcatcgccgcggtgagacgctccgccgccggcgcctcggagagcgcggcatcgtccagaaagtcgttgatatccccgaggcaagacgccggggtgagattaattttttcaaacagcgaggcgtaaacgccctcgcccgcgctgttttcctgcagcgtggtttgcccctgaacaggggcgttttctgtggtaacagacat

SEQ ID NO: 92 - DNA, 1677 bp, Klebsiella pneumoniae
atggataagccactgcggttgaagttaaaaaagtgctaccacctggctcgcccggcgcatgtggttaacgcttgttttatcgcagtgctgtttttctccacgctgctgatctggcgtgaaatcaatgtcctggaagaggcctacgtggccaaccagcgtaataatctggctaacgtcgctcatgaaatggatgggctgttgcagttcaacatcgacagaatgatgttttttcgccatgggatgcaggcggcgctcgaacagccgctcgatatcgatgtattgcgtaaggccagccaacgctatctgagccagcgccatcagcaggcctggcgggtggcgctaccgaatcggcgtacgctgccggtgtttggcatctcgggcagcgtcgctggcgacaaccctatcctgctggtggacgatccgctggcggctgatgaactaatggcgacgctcgagctgggttatctgctaaatctgacgcagcacgatcgcgatttcgccgagcggatgcagtatatctctcgtagcggcttttttacctcgaccctgccgctgcgggatgagtcgcaggtgataacgcactattcccaagccctcggcgctccgtggtttacccgccagacccagcgaaataatccggggcgaggcgttatctggcaaacctttcctgacgatgacccgcagctggaagagcaggtggtcaccgcttcgataccgttggattttgccggttactggcgcggcgtgctggcgatggatttctcagtcagtgaaatcaaagcgtttttggttagcgccatgcaggggggacaagagggagagtaccaactttatgatagccatttgaacctgctggcttcttccgcgccggggaatgtcctgaccctgctgtcgccgcgcgagcaggagctgctgagccgcgcgtttgtccatgataaccagggagggctgcgtctgctgacgcgctatatcagctgggccaaactgcgcaattttgacggcgtgctgctgcggatccacactctgcgggaaggcgtccgcgggaactttggcaccatcaccatcgccctgaccctgatgtgggtcctcttcaccttgatgctgttgctctcctggctggtgatccgccgcatggtccgcaacatgagcgttctgcaaacctctctggagtggcaggcatggcatgatgccttgacccgcctgctcaatcgcggggcgctgtttgaacaggcgatggcggtagccagcgactgccagcgcagcggacggccgctggcggtgatccaactcgatctggatcattttaagcacatcaacgatcgctatggtcatcaggcgggggacagggtgctgtcgatggtggccagtacgctgtccagcgcggttcggcagggcgatctgctgggcagagtgggcggagaagagttttgtatcgtgatgccgaataccaccctgcaggaagcggcggcggtggcggagcgattgcgccagcgtatccagggacgggaagtctttttgcataacaacgtgacgctgcgggttagcgcctcgttaggggtgagcgccagcgaagagcggggggagtatcagtttgaagcgctgcagtcggtggccgatgggcgactctatctggccaagcaaaatgggcgtaaccaggtctgttttcgcagcgcagcg

SEQ ID NO: 93 - DNA, 933 bp, Klebsiella pneumoniae
atgccacgggctgtcagcctcgtagaccccagtggcctcggtcatatagccgccgaggtagctcttcagctcagcacggttcagacacaagttggccgctttgcgcacgcggatgtcctgccacggcgatcctttttcaaaggagaactgccagggccacagatgcggctgggtgttggcgtagaggtgaaaaccctgagacttgatctgatcgatggcgtccggcgccggggcttcaatccagtccacctgcttcgacaacagcgccgcggtacgggcgttggcctccggcaaggggatcagcaccactttatccacccggggaatgcgatctttgttccagtagtcggggtttttatcgaggatcagctgctgacgcggcaccagcttctccagtttgaacgggccgctacccaccgcgtgggcggcgaaggcggtccacgcctgtttgctgcgcgcggcgctatctcccacgctggccggcaccgcgtcatactgcttctgccacgccgtcggcgagacgataaacaggttggtgatgttgtacggcagcagcgcatccggttccgaggtggtcagcgccacggtgtggtcgtcaattttctctgcgccggtgagggtcggcatgcgcgacagggtgttgccgatctgacccggggcgtactgcggcgccgctttattcagtaccttatccacgttccagacgatggcgtcggcgttcacctccgtcccatcatgaaacttcacccccggacgcagggtgaaaatccagcggctggtattctgcggatcgatgtgccactcggtcgccagccccggcaccagaccgctgggcttttcaccttgcgacagatcccactccaccagcgcgtcgtacagcgggatgccggtaaagcggttgccctcatagccttgatccggctggccaagggt

SEQ ID NO: 94 - DNA, 1287 bp, Klebsiella pneumoniae
atgatgattactctgcgcaaacttcctctggcggtcgccgtcgcagcaggcgtgatgtctgctcaggcgctggctgtcgatttccatggctacgcgcgttccggcattggctggaccggcagcggcggcgagcaacagtgcttcaaagcgaccggcgctcaaagtaaataccgtcttggtaacgaatgtgaaacctatgcggaactgaagctgggccaggagctgtggaaggaaggggataagagtttttatttcgatactaacgttgcctattccgtgaatcaggaagatgactgggaaagcacctctccggcgttccgtgaagccaacatccagggtaaaaacctgatcgactggctgccgggctccacgctgtgggcgggtaaacgcttctatcagcgtcatgacgttcacatgatcgacttctactactgggatatctccggcccgggtgcaggtctggaaaacgttgaccttggcttcggtaagctctctctggccgctacccgtaactcagaaagcggcggctcttatactttctccagcgatgacaccaaaaaatatgctgcgaaaactgccaacgacgtctttgatatccgtctggcgggtctggaaaccaacccgggcggcgtgctggagttaggggtcgattacggccgtgctaacccgcaggatgactatcgcctggaagacggcgcgtcgaaagacggctggatgtggaccggtgaacatactcagtctatctggggcggcttcaacaagtttgtggttcagtacgccactgacgcaatgacctcctggaacagcggccactctcaggggaccagcatcgataacaacggcagcatgatccgcgttctggatcacggcgcgatggacttcaacgatgactggggcctgatgtacgtggcaatgtaccaggacgtggatctggacagcaagaacggttctacctggtacaccgtgggtgtccgtccgatgtacaaatggacgccgatcatgagcacccagctggaaatcggttacgacaacgtgaaatcccagcgtaccagcgaaaacaacaaccagtacaaaattactctggctcaacagtggcaggcaggcaacagcgtctggtctcgtccggctatccgtatcttcgcaacctacgcgaagtgggatgaaaactggggctacagcaacacctccggtctgcagacgaaagacagcagcggaagcggcgctttcacctccagccgcggtgacgacagcgaagttaccttcggtgcccagatggaagtgtggtgg

SEQ ID NO: 95 - DNA, 1152 bp, Klebsiella pneumoniae
atggggtataaacgcgtgccggagccgccggccagaacaatacctttcatctttacttccttattagttattcagaccaaggcgctcaccggcataggagccgtccagcacgcgctgccaccaggtctgattgttcaggtaccagtgcacggttttctcaatcccgctctcgaacgtctcctgcggcacccagcccagatcgcgctgaattttcgcggcatcaatggcataacgcaggtcgtgtcccggacggtcggtgacaaaagtgatcaggtcagcaaagtgggtgatgttgcccggcttctgcgccaccactttgtcgagaatggcgcagatggtgcgcaccacatcgatatttttacgctcgttatgaccgccgatattgtaggtctcgccgctcttgccttcggtcgccactttgtacagcgcacgggcatggtcctcaacatacagccagtcacggatctgctccccgttgccatataccggcagcggtttacccgccagggcgttgagaatggtcagcgggatcagtttctccgggaagtgatacggaccatagttgttggagcagttggtcaccaccaccggcaggccgtaggtgcggttccaggcgcgaaccagatggtcgctgcccgctttggaggcagagtacgggctgctcggagcgtacggggtttcttcggtgaacaggtcatcggtgccgtgcaggtcgccgtacacctcatcggtggagatgtggtggaagcggaaggcctgcttctgcacgtccccaagtccggaccagtagtgacgggccgcctccagcatagtaaaagtgccgatcacgttggtctggatgaaggctgccggaccatcaatggaacggtccacatggctttctgccgccaggtgcatcacgatatccgggcggaactcgctgaactgggccgccacggcagcagcatcggtgatatcagtctgggaaaacgagtagcgttcgctcccggccaccggcgccagggattcgaggttgccggcgtaggtcaggcagtccatcacgcggacttcatcccgggtattttcaatgatatgacgaaccacggcagagccgataaagcctgcaccgccggtgacaagaatcttcatactttctctcgtttttcaatgact

SEQ ID NO: 96 - DNA, 1422 bp, Klebsiella pneumoniae
atgcctgatatttcaacgcccaacctcgactataacgacatggttgaggcatgggatattaatgatgcgctgatgggcggcacgctggaaatgcgccggcagggcaagaagtatctcccgaaatggccgaacgaagatcctgaaagttataaggagcgtttggcttcggcaacgttactccctgcctatgaagaggccattaaacaaaacatcgggcgagtgtttgctgagccgacggtactgagtgaggattctcctgaacaaatacgggagctgtcgccagatattgatatggaaggaaaccggctcgatgtctgggcacagcaatttttcaatatcggattccagtatggtctggtacatgcgctggtggatttccctaaaattgaccgggaggcagtaaaaactaaagccgacgaaaaagccgcgggatcccgcccgtatgccacgatgcttaatcctcgccaggtcatcggctggaaatcgaaagtggttaaagggaaagtggtgctgactgatctgcgtatcagagaggtcatcattgttgatggcgatgattatgggcaaacgaaagttgagcaaatacgccatatcatgccgggcaaggttgaaatttatcgccgaaataaaggtgataacggcgaaagccagtggcagattcacgacgagtgggaaaccagtcgcgatgatattcccctggtgacgctttatacgaaacgcacaggctttatgcgcggttcaccgccactgcttaatctcgccttactgaatatcaagcactggcagagtcagagtgaacaggacaacatcctgcatgtcgctcgcgtgccgttgctggtggcttacggtctggctgatggcgaaacgttgacgataggttcttcctctgcgactcgtttcgatgaccgccagcggcagggactggaatatgtcgagcataccggggctgcgattgaagccggtaagatttcccttgaagatctggaaaaccagatgcgtcaggccggcgcaaaactgctgcgcgcggaaaacacatcgactaaatccttagaccagactcacgaagagcggatgcaggagaattcacctctctacaccatggcaagctcgcttgaggatgcgctcgataatatcctgcagattatggcggaatggctgggcgagaaagagggtggcaatgtcgatgtacgcaccgaactggatgtttcagcccagacgtttgatgccgcagctgcaacagctgttcagtcgctccgtcaggggggggatatacgtcaggtcgatgctgttcgcgttttgcaggccctcaaatttatcgatccggatgcgaagcccgaagaggtaatcgacgagctgcgaaatcagcaggtcacgctggccggcggactgagtaacccgggtggtgcaaatggcaacggcgaa

SEQ ID NO: 97 - DNA, 2025 bp, Klebsiella pneumoniae
atgaacgaatttacgggatcggcagcttcacaggctgactttatttggaagaatgcggaagacctgtggggtgacttcaagcatacggactttggcaagatcatcttgccgtttaccctgctacgccgtctggagtgtgcgctggagccgacccgcgaggcggtgagagaagcgcatgacgctttcaaggatgccgatgttgagctggataccattctgcgctcaaccgctgaataccccttctacaacacctctgaatactccctcggcaccctgggtagcaccaagacgcgccgcaatctggaagactacatcgccctgttttcggataacgcccgcgctatcttcgaggagtttgagtttggcaatacggtgatccggctggagaaagcgggcttgctgtataagatttgccagaacttcgccaagatcgacctgcacccggacgtggtgccggatcgggtgatgagtaacatctacgaacacctgatccgccgctttggtgctgaggtcaatgaaggagccgaggacttcatgacgccgcgtgacatcgttcacctggcgaccgcattgctgcttgacccggatgatgccctgtttgaggccagcccaggtttgattcgtaccctgtatgacccgacctgtggcacgggtggcttcctcaccgatgctatgaaccatgtgggggactacggtaaccgcgacaagatcccgccagtgctggtgccgcacgggcaggagttggagccggaaacccatgcggtttgtgtggccggtatgctgatccgccgtttggagtcggaccctggccgagatctgtcgaagaacattcgtcagggcagcacgctgtccaacgaccagtttgccggtgagcgtttccactactgcctgtccaatccgcctttcggcaagaaatgggagaaggacaaaaccgctgtcgaagcggaacacaaaaaaggcgagctgggccggtttggtccgggcctgccgaaaattagcgatggctccatgctgtttttgatgcacctggcgagcaagctagaactgccgatcaacggcggtggccgcgccgctattgtgctgtccggttcgccactgtttaacggcggtgccgcgtctggcgaatcggaaatccgccgttggttgctggaagacgacctgattgaagccattgtagctctgccaacggatctgttcttccgcaccaatatcgccacctacctgtggattctgtccaacaagaagcctcaggagcgcaaaggcaaggtgcagttgatcaacgccaccgacctgtggacttcaatccgcaacgagggcaacaagcgccgtattgtcagcgatgagcagcgccgccagattctggacatctacgcagcaggcgaaaccggtgcgctttcccggatgctggactaccgtacctttggctaccgccgtatcagggtcctgcgcccgctgcgcatgaccctagagctggataaggtgggtatggagcggttggaagccgaagctgcctgggaaaagctctctgacgcgcatcagacattctggcgcgaagccctcaagccgctgatcgggcaaacgcagccctatagctgggcagaaacctttgttagcaactcgatcaagtccgatgaagccaagcagctcaaggtcaaatccaacaagacattgatcaccgcgctaatcaacgcctttggtcacaaagacccgaaagccgagccagtcacggattcaaacggcgagctggtgccagacacagatttaactgattacgagaacgtcccctatctggaggacatcgacgactactttgcccgcgaagtgcttcctcatgtgccggatgcctggctggatgagagctttaccgatgccagggatggtcaattgggccgcgttggctacgagatcaacttcaaccgcttcttctaccagtaccagccgccgcgcaagctgcatgatattgatgaagacctgaagcaggtagaagccgagattgccgcgctactggcggaggtggccagcgaa

SEQ ID NO: 98 - DNA, 1896 bp, Klebsiella pneumoniae; identical to SEQ ID NO: 16

SEQ ID NO: 99 - DNA, 1797 bp, Klebsiella pneumoniae
atgacgacacaggccccaccttccaacttgctgccgctcaacccggagcaactggcgcgccttcaggcggccaccactgacttcacgcccactcagctcgcctgggtatctggctatttctggggcgtgctgaatcagcagtccggcgcggcggtagccgcccccgccccggccgccgaggtaccgacgatcacgctgatttccgcctcgcaaaccggcaacgcccgccgcgtcgccgaagcgctgcgtgacgatctgctggcggcgaagctgaacgtgaagctggtgaatgcaggcgattataaattcaaacaaattgctgcggaaaaactgctggtggtagtgacgtccacccagggggaaggagagccgccggaagaagcggtcgcattgcataagttcctgttctctaagaaagcgccgaagctggacgggactgcgttcgccgtctttggtctcggcgatacctcttatgaatttttctgccagtccggcaaagatttcgacaacaagctggccgagctcggcgcggaacgtctgctcgatcgcgttgatgccgacgttgaatatcaggccgcggccgctgaatggcgcgcgcgcgtggttgaggcgctgaaggcccgtgcgccggtcgctgcgcccgctcagctggccaccagcggcgcggtgaacgatattcacaccagcccatataccaaagaagcgcccctgacggcgaccctgtcggtcaatcagaaaatcaccggccgcaattcagaaaaagatgtgcgccatatcgaaatagacctcggtgattccggtctgcgctatcagccgggcgacgccctgggcgtctggtaccagaacgatcctcagctggtgaaagagctggtggagctgctgtggctgaaaggcgacgagccggtgaccgttgagggtaaaactctgccgctgtcggaagccctgcagtggcattttgagctgacggttaacaccgcgactatcgttgaaaactacgccaccctgacgcgcagcgaatcgctcgtgccgctggtgggcgacaaagctcagttgcagcagtatgccgccgcgacgccgatcgtcgatatggtccgtttctctccagcgcagctggacgctgaggcgttaatcggtctgctgcgtccgctgacgccgcgcctgtattctattgcttcctcacaggcggaagtggagagcgaggtgcatgtcaccgtgggcgtggtgcgctatgaaattgaaggccgcgcccgggctggcggcgcctccagcttcctcgccgaccgcgtggaagaggatggcgaagtccgtgtctttatcgaacacaacgacaacttccgtctgccagccaacccggagaccccggtgatcatgattggcccgggcaccggtattgcgccgttccgcgcctttatgcagcagcgcgctgcggacggagcgcaaggcaagaactggttgttcttcggcaacccgcacttcaccgaagatttcctctatcaggtggagtggcagagctatgtgaaggaaggtctgctgacccgtatcgatctggcctggtcccgcgatcaacaacaaaaaatctatgtgcaggacaaactgcgcgagcagggggccgagctgtggcgctggatcaatgacggcgcccacatttatgtctgcggcgacgccaatcgtatggcgaaggacgtggaaaacaccttactggaagtgattgccgaatacggcgcgatggacgccgaagcggcggacgaatttttaagtgagctgcgcgttgagcgccgttatcagcgagatgtctac

SEQ ID NO: 100 - DNA, 357 bp, Klebsiella pneumoniae
cctccgcaaccaaatccaacggtctggcgatcagcatgccctactgggatgagcgggtggaagagatggccaaaaactatcccgaaattcgctgggacaagcagcatatcgatatcctgtgcgcccgcttcgtgctgcagccggagcgttttgacgtggtggtcggctccaacctgttcggcgatattctctccgatctcggcccggcctgtaccggcactatcggcattgcgccgtcggccaatctcaatccggagcgcaatttcccgtcgctgttcgaaccggttcacgggtcggcgccggatatttacggtaaaaatatcgccaacccgatcgccaccgtttgggccggggcga

SEQ ID NO: 101 - DNA, 321 bp, Klebsiella pneumoniae
tgctgctcggcctgctgggttgggataaatacgacggcaaggtggagtttatcaccgagctattcgccagctccggtaccggccaggttaacgccgtgttcccgttgccagcgcaggcgtaagggggccccatgccgcattttatcgccgaatgtaccgacaacatccgcgagcaggccgatctgcctgggctgttcgccaaagtcaacgaggcgctggccgccaccggcatctttccgatcggcgggatccgcagccgcgcccactggctggatacctggcagatggccgacggcaggcaggattacgccttcgtgcata

SEQ ID NO: 102 - DNA, 342 bp, Klebsiella pneumoniae
ccagtacctggaagtggatggcgtagagctgaagttcgtgaaaggcattttcgcgattttcggccatggcaacgtcctggggctggggcaggcgctggagcaggacagcggcgatatgcgcgtctatcaggggcgcaacgagcaggggatggcccacgcggccaccggttttgcccgccaggccctgcgccggcagattatcgcctgcacctcctccatcggtccgggagcggccaacatgatcaccgccgccggcaccgccagcgccaaccgcatcccactgctgctgctgccgggcgatgtcttcgccacccgccagccggatccggtgctccagcagat

SEQ ID NO: 103 - DNA, 378 bp, Klebsiella pneumoniae
aagatgacgagatggagttcggcgtcggcattcacggcgagccgggcatcgaccgccgccgcttcagctcgctggaccaaaccgtcgatgagatgttcgataccctgctggaaaacggcgcttacagccgcacgctgcgccagtgggataccgtcaagggcgcgtggcaggaagtacagcagagcaaaaccgcgctgcaaaacggcgaccgggttatcgcgctggttaataacctcggcgccactccgctttccgaactgtatggcgtgtataaccgccttgcccagcgctgcgaagcgtccggcatcatcatcgaacgcaacctcatcggcagctactgtacttcgctggatatggcgggcttctccatcactctgc

SEQ ID NO: 104 - DNA, 558 bp, Klebsiella pneumoniae
aaagccggacgtggggcgggtgatcacctcgctggtgctgatcgaaagtatcgccctgatcgccatctgtctgacgctgggcaaggtggttgcgcaactgctggcggggagcgtcttcgagctgccgaccttcgtctgcgtgctgtttatcggcgtgatcctcagcaacagcctggcgctggcggggttgtatcgggtgttcgatcgcgcggtatcggtgttgggcaacgtcagcctgtcgctgttcctcgccatggcgctgatgagcctcaagctgtgggagttggcctcgctggcgctgccgatgattattatcctggcggtgcaggcgctggcgatggcgctgtatgcggtgttcgtcacctatcggatgatgggcaaaaactacgatgccgcggtgctggcagccgggcattgcgggtttggcctgggggcaacgccgacggcgatcgccaatatgcaggcgattaccgaccgtttcgggccatcgcatatggccttcctggtagtgccgatggtgggggcgttctttatcgatatcgtcaacgcgctggtgat

SEQ ID NO: 105 - DNA, 75 bp, Klebsiella pneumoniae
cgacaacgcgctgctggcgctggcggcggcggtggagcaaggctccagccacccgctggcgcaggctatcgtccg

SEQ ID NO: 106 - DNA, 363 bp, Klebsiella pneumoniae
ggtttaccgacgttcgcttcaacgttgaattcacgcttcatacggtcaacgatgatgtcgaggtgcagctcacccataccggcgataatggtctggttagactcttcgtcagtccatacgcggaaagacgggtcttctttagccagacgacccagagccagacccattttttcctggtcagctttggttttcggctcaacggcgatggagattaccggctcagggaattccatacgctccagaatgatcggcgcatccgggtcacacagggtgtcaccagtggttacgtctttcagaccgatagcagcagcgatgtcgcccgcgcgaacttctttgatctcttcacgtttgttagcgtgcatc

SEQ ID NO: 107 - DNA, 648 bp, Klebsiella pneumoniae
accgccgctgcaggtggccccgtttctgctggaagagcagctggcagacgatgtggaagccacccattttgctctgctccaccgccagcaggcccagtgcgagatcgtcgccgtacagcggcaaaaaatgcgcgactggctggcgcgctgcgaatcgctctccttacagcccctggcgttgacgcccgacgtgctggccctgccctggcaaccgccggcgtggagcgcggtgcaggtggacgagcagtggctgatccgccaccagccgtggggcggcatggcggcggaaaacgtctggctgacggagctgctgcagagcgaggcggaagagcacgtcatcgacagctattcgccgccgcccgcggcgccgggcgtctggcgggagcagcctgcgcagacattgctgacccttgccgcacgccatccggcagcgcagaaactcagtctgctgcagggggagttcgccgtccggcggcggtctgcgcaggcgagctggcgtccggcgcggtatgccgcgctggctctggcgttactggcaggggcaaacagcgtgctggaccatcgcgatctggcgcgtcaggccgaggcggcgcaacaggccagccgggccttctatcaccgctggtttccgacggagaaaaaggtgat

SEQ ID NO: 108 - DNA, 168 bp, Klebsiella pneumoniae
aggcgccgcggccttcctgcgtcgccatgctcaggaagagatgacccatatgcaggggctgttcgactatataaccgacaccggcagcctgccgcgggatcaacgctatcgcctccccgtttgccgaatatgcctcactcgacgagctgttccgccagacctacgagc

SEQ ID NO: 109 - DNA, 213 bp, Klebsiella pneumoniae
aagcaccctgctgaagatggtcgccggcctggtggagcccagcgacggcaagctgatgctgtggcggcgcgacagtcgggaaaaggcccagcatccgctgtcgttcgtcttccaggaagccaccctgatgccgtggagcagcgtgcgcaacaacgtcaggctgccgctggatctggccggcgtgccgcgggcggagggcaatacccgggtgaa

SEQ ID NO: 110 - DNA, 294 bp, Klebsiella pneumoniae
tctcgtccagacgcggctgctgggtctgctggcgattgcgctgctctgcggcgcggcggtggcggtggccgggccgatcggctttgtcgggctggtggtgccgcacgtggtgcgccgtctggtgacggaagatatccgcctggcgctgcccctggctgcgccggtgggagcgctggcgctggtgctggcggatatcgccgcccggacgctggtcgcgccgcaggagctggcgaccggggcgatgaccgccctggtgggtgcgccgttgtttatctttatcgccgcgaggttttt

SEQ ID NO: 111 - DNA, 123 bp, Klebsiella pneumoniae
ccttccggtttcagggtagctttgttgaagttgaacagaacgtcagacttcagggtgaagtgcttggtagccacttccggagccggagccggagccggagcaacaaccggtgcagcatcttcc

SEQ ID NO: 112 - DNA, 444 bp, Klebsiella pneumoniae
gctgcgtaccccgctggcggtgctgcgcggcgagctggaggcgattcaggacggggtccggcgctttacccccgagtcgattccttctctgcaggccgaggtggctaccctcaccaagctggtggacgacctccatcagctgtcgatgtccgacgagggggcgctggcctaccagaaaacctcactggatatcatcaccctgctggaagtggcggcgggcgcttttcgcgagcgcttcgccagccggcagctaagcattcaggtgtcgctcccggagcaggcgatgatcttcggcgaccgcgaccgcctgatgcagctcttcaacaatctgctggagaacagcctgcgctataccgacagcggcggcagcctgcacattaccgcccgccgcagcggtcgcatgctggtgattgtcttcgccgacagcgcccccggcgtcagcga

SEQ ID NO: 113 - DNA, 306 bp, Klebsiella pneumoniae
agcgctgtggcgtcttgccctccctatgattttctccaacatcaccgtcccgctgctggggctggtggatacggcggtgatcggccacctggacagcccggtatacctcggcggcgtagcggtcggggcgacggccaccagtttcctcttcatgctgctgctgttcctgcgcatgagcaccaccgggctcaccgctcaggcctggggcgccaaagatccgcagcgcctggcgcgggcgctggtgcagccgctggcactggcgctgggcgccggggtgctgattatcctgcttcgcctgccgctaat

SEQ ID NO: 114 - DNA, 159 bp, Klebsiella pneumoniae
accgttcttcaccaccaaagccaccggcagcggcagcggcctggggctgtcgatggtgtatggctttgtgcgccagtctggcggccgggtggcgctggagagcgcgccggggcaggggacgacggtgcggctgcagctgccgcgagcgttgaccgaggt

SEQ ID NO: 115 - DNA, 345 bp, Klebsiella pneumoniae
tggcctgctcggcaccggtctgcgcagtgcgccgcgcgatcccgttgcggcgctcatccaccaggcgaaccaccacccggcgccggtggtggcgctggatatcccttccggcctgaatgcgcagacgggcgcgacgccaggtgcagtggtacaggccgaccatacgctgacctttatcgccctcaagccggggctgctgaccggcaaggcgcgggatgtcgtcgggcaactccaccatcatgcgctggggctcgaacgctggctcgccggacaaagcactcctctgacgcggttttgcgccgcccacctcgccgactggctgccgccgcggcgggccacctccca

SEQ ID NO: 116 - DNA, 93 bp, Klebsiella pneumoniae
tgcagggcgcttcgtggttcagtcagaacagtcagaaacaacgcaatccgcagctggaagagctggcccgcacgctggcgcagcaggtggtgc

SEQ ID NO: 117 - DNA, 267 bp, Klebsiella pneumoniae
gccgtctacccgtttcgtgctggagtttatgggggaagtgaaccgcctgcagggggtcatccgcggtggacagttccacgtcggcgcccaccgctggccgttaggctataccccggcataccaggggccagtggacctgttcctgcgcccgtgggaagtggacatcagccggcggaccagcctggattcgccgctgccggtgcaggtcctggaggccagtccgaaagggcactacacccaattagtcgtccagcctctggggtggta

SEQ ID NO: 118 - DNA, 210 bp, Klebsiella pneumoniae
gcgtccggtgacccggctggcggtgctgccggtggcagcgaaggccagcgtggagcaggggctggaggcggcgctggagagcgccctggcgcactggctatatcacgacgagatctggctgcgcggcaacgcaaaagccaaagcggaaattctgctggcgatagcccgcgtgcgccatgccctcgtgctgtttggcggcatcgtgccgcg

SEQ ID NO: 119 - DNA, 144 bp, Klebsiella pneumoniae
ttcgcgaagactaccgcaagaagtgcgtggcgctggccgatgcgctggaaagccgccttggcgagcacctggaattcagccgcccgcagggggggatgttcctgtgggcgcgtttccgctatccgttcgataccatggaatgga

SEQ ID NO: 120 - DNA, 168 bp, Klebsiella pneumoniae
actgcaccggctcctgcagctggaaaatttacgtcaaaaacggcctcgttacctgggaaacccagcagaccgattatccgcgcacccggccggatctgccaaatcacgaaccgcgcggctgcccgcgcggcgccagctactcctggtatctctacagcgccaaccgcc

SEQ ID NO: 121 - DNA, 321 bp, Klebsiella pneumoniae
ggagaaggcgatgtcgatattaattgcatttttgggcggaatgttaaccctgctgagcccctgtacgctgccggtgatcccgctgctgttcgccagcgtccggggccgccgggggcagctggcgatcatgctggcaggaatggcgctgatgttcggcgctgtctcctggctggtgacggtcgccagcggctgggtggtgaatctgacccttgcaggccgcggtctggcgctggcgttcttcgccctggtcgggctgagtctgctttcgcaacgcgtcgcgcaacggctgacctcacccctggtagcgttggggaatcagct

SEQ ID NO: 122 - DNA, 141 bp, Klebsiella pneumoniae
tccgccgatgcccgctccggcaccctgccgccgcggcgtcgaacgtctggtttatccgggaggcgatacggcgctgctggtcttcattccgctgccggatggcgcctcgctggcggccctgcggctgctggcgcagcattg

SEQ ID NO: 123 - DNA, 183 bp, Klebsiella pneumoniae
tctgagcgcagggatatcttcattgctgctggaggcggcggttgccgggtgcggcattgcgatgcttcccgaactggaggcccggggcgcgattgccagcggcacgctggaggtggtgcttccggagtggacgccgaaggcgttgagcgtttacggcatctatctttcccgcgactaccaacc

SEQ ID NO: 124 - DNA, 249 bp, Klebsiella pneumoniae
gcgccggtttcaacgccagcaccagcaaaacccagcggccgttcagccagtcgccgatccccagcgtttacagcgagatcatgcagccggaggcagacagccgcagctacaccctcggcggctttgtccaggataagatcaacttcgaccttgatagccacaacttcgccattattcccggcgtgcgcgtggtgcatcaatcgactaagccggaaaatctgtccgaccttgccgccaacagcagcgtac

SEQ ID NO: 125 - DNA, 453 bp, Klebsiella pneumoniae
tccgctgattgctctgctgcgcccggtcagcccgctggcctggctgccgattggcctgctgctgttccagaaggcggagccggcttccagctggaccatttttatctgctccatctggccgatggtgatcaacaccgcggagggtgtgcggcggatcccgcaggactatctcaacgtcgcccgcgtcctccagctctcggagtggacggtgatgcgcaaaatcctctttccggcggtgctgccggcggtgcttaccggcgtgcgcctctccatcggcatcgcctggctggtgatcgtggcggcggaaatgctcaccggcggactggggatcggcttctggatctggaacgagtggaacaacctcaatgtggaaaacatcatcatcgccatcgtcattatcggcgtcgtcggcctgctgctggagcagggcctgatgctgctcgctcgccgctt

SEQ ID NO: 126 - DNA, 267 bp, Klebsiella pneumoniae
ccgccaccgtcttcagcccggagctgcaaaattccgcccgccgcgacggccaggaaatccagcttaaagccctgcagcagtactggcagctggcgctggcccccgggatgcagcgcgcagtcaatcaggcggaagtggcccaggatgtcgccgactttgtcgatcgtatcgaccagttggtcaccgcattcgaccacaccaccgagcagcgtatcgaacgggtggtctggatctatcgcatcctcgccattggtatggcgctgctgc

SEQ ID NO: 127 - DNA, 135 bp, Klebsiella pneumoniae
gtcttttcgatttcctctacctgttcgcctggtcgtcgaccatggctttcttcgttatctggaccacccagcatcttggcatcagcgccacgaagaccgggctgctttactcggtcaacgcctttatcgccctgc

SEQ ID NO: 128 - DNA, 114 bp, Klebsiella pneumoniae
ttaccgcgggcccgacccgtgagccattggatccggtgcgttatatcaccaaccacagctctggcaagatgggcttcgcgattgccgccgccgcagcgcagcggggcgcgaatg

SEQ ID NO: 129 - DNA, 96 bp, Klebsiella pneumoniae
attgctgtatgcccggcgggaaatgctcccgttggtcagcaaccatcgcactcgcattttcgaggcgataatggccggggagccggagcaggcgcg

SEQ ID NO: 130 - DNA, 309 bp, Klebsiella pneumoniae
cagcgaggcggtggctgccgccgtggcgtcgctgcccgccgatttcgccgatatcaccaccctgatcaacaacgccgggctggcgctgtcgccgctgccggcgcaggaggtggcgctggaggactggaaaacgatgatcgacaccaacgtcaccggtctggtgacagtcactcacgccctgctgccgacgctgatccgccatggcgccggggcgagtattatcaatatcggctcgatcgccgggcagtggccctatcccggcagccatgtgtatggcgccagcaaggcgtttgtgaagcagttcagcta

SEQ ID NO: 131 - DNA, 153 bp, Klebsiella pneumoniae
tgtgccctcccagtcgctggagcacggcatactcaggttcacgctgcactatggcaaagtgggcgctatcgactatgccgacggctcggacaccacccgcctgtggaattccctgcccacctcttccggtactatcctgcgcttaagcgacct

SEQ ID NO: 132 - DNA, 315 bp, Klebsiella pneumoniae
cggtcaggcctcaatgggcatgatggtcgccgggctggcgatgatgggctttgccgaactgtttatcgacccggtggcgatggcgcaaatcacccgtctgaacatgcccggcgtcaccggcgtattgaccggcatttatatgctggccaccggcgcggtggccaactggctggcgggcgtggtcgcccagcaaaccaccgaatcgcaaatcagcgatacggcgattgccgcctatcagcatttcttcgcgcagatgggcgaatggactctcggctgcgtggcggtgatggtcattatcgcctttgccgcggcctg

SEQ ID NO: 133 - DNA, 246 bp, Klebsiella pneumoniae
gctgttcagccggggacgcggcgccggcgcgccgctggcgtggcaggtatggggcggcagttttcatatggatcgctggtcagagagcgggaaaaagacccggccggcgaaagagagctggctggcaggcctttcggcctccgggtcgctcagcaccctgagctgggcggctacgggctatggctacgacaaccaggcggtgggggaaacccgcctgacgctaccgctgggcgagtcgatcaacgt

SEQ ID NO: 134 - DNA, 108 bp, Klebsiella pneumoniae
gccatcacgctggggaaaaatggatacgctgggcctgttgttcagcatcgggatcttctttctccagccggtgcaaaaccttgcctggggcggtgtattcaaggtgat

SEQ ID NO: 135 - DNA, 168 bp, Klebsiella pneumoniae
ataccctcgcctggcaggggcaggcggggcaacaaagggaggggctgtcggacagccttattaaatcggccaaagatctggtgggcgggaaagacaagccggtcatcgaccagtcggcagccggcccgcaggggcctctggatgacacgttcggcccactgctccagc

SEQ ID NO: 136 - DNA, 405 bp, Klebsiella pneumoniae
ttgccatcgaaggcaccttccagggcggcagtatgggcgaagtctccggcgccaaaatggccgccgcgctggagctggcggcggaagataaccgcaacggtatcccgacccaggcggtgctgtgcctcgaaaccggcggcgtacgtctgcaagaggccaacctcggtctggccgccatcgccgatattcatgccgcgattgtcgacctgcgccgctacaccccggtggtcggcattattaccggtaccgtcggctgcttcggcggtatgtccatcgccgcggcgctgtgcagctaccttatcgtcacccgtgaagcccgtctcggcctcaatggcccgcaggttatcgagcaggaagccggcattgaagagtacgactcccgcaaccgtccgtttatctggagca

SEQ ID NO: 137 - DNA, 273 bp, Klebsiella pneumoniae
cgctgcagggttcgcgcgcatcgctgctggttgaggatgacggcccgggaatcgcccccgaggagcgcgagcgggtgtttgagccctttgtccgccttgaccccagccgggaccgggcgacaggaggctgcggcctcggcctggcgattgtccacagtatcgcccaggcgatgggcggcgaggtgcgctgcgaggccagccctctcggcggcgcccgcttctgctttagctggccggtctatcatcagctgcctgatttcacctctgcctgaa

SEQ ID NO: 138 - DNA, 138 bp, Klebsiella pneumoniae
cgatcttcagccgctggcccgggtggtcggcgtggcgacagcgggcgttgcgccgcggatcatgggctttggcccggcgccggcggtgcgcaaggtgctggcgcagaccggcctgacattaggccagatggatgtcat

SEQ ID NO: 139 - DNA, 135 bp, Klebsiella pneumoniae
attgttaaatatcagccgggccgatcaggacgctttcgcctggcgcagccagcagcgcacggcgcaggcccagcgcgacggcattctggcgcaggagattgtgccggtgcagattgtcggccggaaaggggcggt

SEQ ID NO: 140 - DNA, 192 bp, Klebsiella pneumoniae
aggcattatgtcgccgtggctcggcgcccagggcatcgtcccgcagtccgacgacggtatggtggtcgccaaaggcacgatcaacggccagcctgcggtggtgattgccatcgaaggcaccttccagggcggcagtatgggcgaagtctccggcgccaaaatggccgccgcgctggagctggcggcggaaga

SEQ ID NO: 141 - DNA, 267 bp, Klebsiella pneumoniae
gcgcggcgaggcgctggaggccaccctgcgcctgcgcgaggagctggccgaacagcggcgcgcgctgctgctgatgcaggagatggcggcccgctacggctgcgatatctctcacccggcgcgcactgcccgggaggcggtgcagtggctctacttcgcctacctggcggcggtgaagtcgcagaacggcggcgccatgtctctggggcgcacggccaccttcctcgacatctatatcgaacgcgatctgcgcgccggtttattgaa

SEQ ID NO: 142 - DNA, 183 bp, Klebsiella pneumoniae
ttaactgcggctcgtcgtcgatcaaattttccgtcctgggcgccgccagctgcgactgcctgctcaacggcgtggccgagggcatcaacgcggaacgggcgtctctctcgctcaacggcggcgagccggtggcgctggcgcagcgcggctacgaaggcgccctgcaggcgattgccggggcat

SEQ ID NO: 143 - DNA, 288 bp, Klebsiella pneumoniae
gcgttttctggctcaccagacgcttattaccgcgatcagtactgcagcctggctggcgccggcccaggtgctgaccgttaccgacagcctgccgtcgaccctgcctgcgcccgtacaggatccgctgttaatcaccggcaccggttttaccgccagccgccgggaggcgctgcgggtgtccctgcttgcggtgccctacagcgaaacattgtgctggcgtccgccgctgctgccgcgcccgaaggtgactggcaccatgacggcgcgggtgaccagcgcgaaagcgaa

SEQ ID NO: 144 - DNA, 456 bp, Klebsiella pneumoniae
ccgagggagcgaaggtggaagttgtcaccgccagcagcggcgagcaggcgcagcccgccccgcgccagagcggtaaacacggagcgcgttcctgatgcaggtgttacctccaggccgcaccggcggcccgtcccggctgtttattatgcgtccggtggccaccactctgctgatggtggctatcctgctggccgggatcatcggctaccgctttctgccggtctccgccctgccggaggtcgattacccgaccattcaggtagtcaccctctatccgggcgccagcccggacgtggtgacctccgccatcaccgccccgctggagcgccagttcggccagatgtccggcctcaagcagatgtcgtcgcaaagctctggcggcgcctcggtagtcacgctgcagttccagctgaccctgccgctggacgtcgccgagcaggaagtgcaggcggccat

SEQ ID NO: 145 - DNA, 354 bp, Klebsiella pneumoniae
cgtcggcattttgaatctcacttcggcgtgccccctccgaatggcgcaaaacatttcgtggtatggcatgatagcacccgaagagagtcaattcagggtggtaaatgtgaaaccagtaacgctatacgatgtcgcagagtatgccggtgtctcttatcagaccgtttcccgcgtggtgaaccaggccagccacgtctctgcgaaaacgcgggaaaaggtggaagcggcgatggcgcagctgaactacattcccaaccgcgtggcacaacaactggcgggcaaacagtcgttgctgattggcgttgctacctccagtctggccctgcacgcgccgtcgcaaattgtcgcggcgat

SEQ ID NO: 146 - DNA, 201 bp, Klebsiella pneumoniae
cggactcagaagccttcccgggtcttatccggcagactcacagaaaaatcagggcagcatcggcagacggcgcttacgacacccggctctgtcacgatgaactgcggcgtaagaaaatcagcgcgcttatcccaccccgaaaaggtgcgggttactggcccggtgaatatgcagaccgtaaccgtgcagtggctaatcagc

SEQ ID NO: 147 - DNA, 426 bp, Klebsiella pneumoniae
agcgttcccctttccagacccgatccagcgccagttgcgagtaggccgccagcagatcgctgcggccacgatggtagtattcgcgcagaatccgccacagatagttcacgtccgatgccgccagatttaatcctttcgccccggttggcggaacgatatgcgccgcatcccccaccaggaacaaccgcccatattgcatcggctccacgacgaagctacgcaggggggcaatgctcttctcaagtgagtgaccagtcactaacctggatgccagctcctccggcaagcggcttttcagctcctgccagaagcgctcgtccgaccatgcttcaaccttatcgctcagcggaacctgcagataatagcggctgcgggtcagtgagcgttgactgcacaatacaaacccccgctgatggtgcgcataaa

SEQ ID NO: 148 - DNA, 573 bp, Klebsiella pneumoniae
cccgctggcgagcaccgtctgcaccggttcactctccagcagacgggcgaactgggcgcgaacgttggcttccaccagggcgtccagcgcatggcgagaacgctccgcgttggcgctggcgctggtgctggcgccgggggaggccgcaatacaacagtcatcggcgatctgcacaatttcgtgatgcagggtgtggcgcagctggccgatgcgacgagccagcgccgaggactcctgcgccagcggcagggtgggcagagagagcgccgcctgtacgccgccgcagccgtagtggccgcagagcaccacccgctccacctcaaggtagtggagggcatactgcaggacgctcatgacgttgtcgtcggcagggtcgagcatgttggcgatattgcggtggacaaagagctcgccgggctggctgccggtgagcacctcggcgggcacgcggctgtcggagcagccgatccacagcgagtggggccgctgcccgtcgatccatttttcgaaatagtccggatcatgctgacacttctgcagcgcccagctgcggttgcgggccagcaaaggttt

SEQ ID NO: 149 - DNA, 132 bp, Klebsiella pneumoniae
gcgcgatatccggccccggcaggcgggtcttcagcacgccccccagccagtcggtcagcaccggcgcccactgcgcgtcaaacccgctcagctgcagcttctccgccatccacccttccggcaccggctggg

SEQ ID NO: 150 - DNA, 798 bp, Klebsiella pneumoniae
cgatgtccagctcaccggccgtcagccggctcacccgccagcccgtgggcaattgctcatccatgcgtacccgtcgccactttccgttcccatcctgcagaaaccccgtccagccagcatcatccccaaccgccccgccatagcgccattgcgaaagctgcgccgtgcggcagggatcctcaaccggctggaaagggtcacgctcggccgccagcagcgacagcggtagccacaggaagatccagcgtttaccgctcatcttccgcctccagcagcagtcgcaggcggagcgtctgcgcctcacggcccagcgaaaacgaacgcggattcatcccgcagcgcgccagccaggaaaaaagcgcgggtaccgttgaccaggacagggtcagctccatctcgccgccgcttccctgcggacgccaggcgataagcttcgctccggagagcggaatggctatgggcgaaaatgactgcgtgtcgatgcgcgccccgggattttcctcgccggggatgcgcagcgccatgatccgccgccactgcgtttgcaacgccgcatcacgggttaccgccgcctgcggagggcgcagatcgcgccagagcgccacgccgcctcccgacagccccattgcgagcaggatcggcagccccgtccaggtgccccgaaggttaatccgcatcagcgcgcgctcccgtcagggtaaaactgaactgccaacgcccctcggcgtcgcgctgggtcccgccggcttttgccggcgcgaatcccgcgacgcgagtcagcgcagcctccacgctggt

SEQ ID NO: 151 - DNA, 516 bp, Klebsiella pneumoniae
aaatcaaaaagtttacgccgcaagcaactctttcgcgttcgccagggtgttgcgcgtgacttcgctgccgcccagcagacgggccagctcctgcaagcgagcacgtttatccagcggctgcatatgggtttcggtcatctcgccatcggtctctttgcagacaaagaaatgatggtggccgcagcatgcgacctgcggcaggtgggtcacgcacatcacctgcgtggactcgcccagctggcgcagcagcttgccgaccacggcggcggtcgggccgctgatgccgacgtccacttcgtcgaagatgagcgccggggtttccattttacgcgcggtgatcacttgaatcgccagcgcaatgcgcgacagttcgccgccggaggccactttggcgattggctgcagcggctgaccggggttagtggtgacgcggaactcaatatggtcggcgtcggcggtgagatggcgttcatcgaacgcgacctcaatcgcgaagaccccgtgcggcatcgaaag

SEQ ID NO: 152 - DNA, 330 bp, Klebsiella pneumoniae
ccgccggccaacagggtgttgatcagcgtcggggaacccggctgcgccagcccgacatggcccagctcagcatccagctgcgtcaccttcacgctatcgccatcgccgaggaacaggcctaccgaggaaataccatgttttttcgcccacgccagcagcgtcttgttggcggttcccgccagcgcgccggtgatgatgtcgatttgctcagccggcgtaacgcgcaggccatttttcttctgcaccggcaggttgagctgcttcatcagctcatccaccacgcagccgccgccgtggacgataatcagcggacgctggtgcgcttcacgg

SEQ ID NO: 153 - DNA, 1401 bp, Klebsiella pneumoniae
cgccagcatctccgcggcctgggtcgaatcgggcaccaggatcggatccactttcccgcgaccgcgaatggtgcggcacagcgagcggctgtcggcgcccgggatcggcgcttcgcccgccggatagacgtccagcatcagcagggcatccacctgggtcagcacgttggcaaaatcatcatacagatcgcgggtacgggtataacggtgcggctggaataccatcaccaggtttttatccggccagccggcgcgcgctgctttaatggtggcgtccacttccgtcgggtggtgaccgtaatcatcgatcagcatcgcgctgcccggtttgccgttgacttcggccagcggaaactcgccaagaaaatcaaagcggcgtccagttccctggaagctctccagtgcgcgcagaatagcccgatcgtcaatcccctcttccgtcgccacggcgacggccgccgccgcgttcagcgcgttatggcgtcccggggcattgagcgtcacctgcaggatcgctttatcctggcgcaccaggcggaaatgcccctgcgccccaacctgacgatagtcctcgacgcgtacgtcggcgtcgtcgctaaaaccgtaggtggtgatctgccggccaacgcgcggcaacagttcccggatcaccggatcgtccacgcacatcaccgcgcgtccgtagaacggcaggttgtgcaggaagttgataaaggtctgcttcagattctcgaagtcgccatggtaggtatccatgtgatcggcttcgatgttagtgacaatggccaccatcggctgcagatgcagaaacgacgcgtcgctctcatccgcttccgcgatcaggtaacggctatggccaaggcgggcatgtacgcccgccgcttttaccagcccgccgttgacaaaggtcgggtccagcccggcctcggcgtaaatgctggataccatcgcggtggtggtggttttgccgtgggtcccggcaatggcgatcccgtggcgaaagcgcataagttccgccagcatttcggcacgacggatcaccgggatacgcgcctcatgcgcggcaacgatttccgggttatctgccgaaatcgcgctggaaacgacaaccacgctggcatcacgcacgttttccgggcgatggttgaaataaatggtggcgccaagctgcgacagctgctgggtcaccggattcggcgccaggtcggagccgctgatctggtaaccttcgttagccaacacttcggcaataccgcccataccggcaccgccgatgccgacaaagtgaatgtgccgaacgcgacgcatctcgggcactatggaacgcagttttgccaaatcttgtgtattcattctttacgccatcaacttctgtattcgggcggtgaaaatcaccgcaat

SEQ ID NO: 154 - DNA, 747 bp, Klebsiella pneumoniae
tctagactgcagcggtgtcaaaaaaaacgggagccttcatgctcccgtttttattttgccgtgctgcccgcagcgctagctcgcggaggccagcagaccatccgcgcggaacatcgccttgataccgcggatcgcctggcgcgtacggtcccggttctcgatcagggcgaagcggacgtgggtatcaccatagtcgccaaagccaatccccggcgagacgcaaaccttcgcttcattaagcagctttttcgcaaactccagcgaccccatggcggcgtaaggttccggtattttcgcccacacgtacatagacgctttcggacactccaccatccagccggcctcatgaagccctttgaccagcacatcgcgacggcgcttatactgttcggcaatatcgcgcacgcactgctgatcgccctccagcgcagctatcgccgccacctgcagcggagtaaaagtcccgtagtcatgatagcttttgatacgagcgagggcattcaccaaagtcttattacccaccataaagccaatgcgccagccggccatgttatagcttttcgacagggtaaagaactcgacggcgacatcccgcgcgccgggcacctgcatgatggagggcgctttccagccgtcatacacgatatcggcataggccagatcgtggacgaccagaatgtcatactgcttcgccagagcgacaaccttttcaaagaaatccagttcgacgcactgcgcggtcggatt

SEQ ID NO: 155 - DNA, 246 bp, Klebsiella pneumoniae
cgttacgctcaatcagcttctccactttctcaaagccgagcatctcaaacagcgcgtcatacagcgggcgcagatacgggtcgaccttctggctcagatcgccgggcaggaagccgagcttttcgcctgcctcgacggccggacgggtcagcagaatacggcggatctcctggcgctccagcgcatcgaccgccgccgccaccgccagataggttttacccgtacccgccggacccacgccgaaag

SEQ ID NO: 156 - DNA, 792 bp, Klebsiella pneumoniae
gagtgctgcgacgaccagttagcgcaggagttgccattcaccaggtggatatcgatatcacgcggattgagcagcagacgcgccttgttgaccggcggccgcgattccatgctcgacagcgccaccagcgccacgcaggtgcccagcgccaacaggaacagcccccacaccagggcggtagtgaggcgcttgcggcctgacggcgcgctggccacggtaggagccggtggcggcgcggcggcatcagggagagggacagagacgtcggatggcgcaccggcggccggcggcgcaggaacggcggtcgacggcgaaggcgtcagcgcctccatcgacggggctagctcctccccctcttcggtgcaccagatcaccggcaccgtgagcttatacccccgtttgggtaccgtcgcgatgtactcaaggctaacgtcgtcgccgtctttgagcgacttgcgcagttcagaaatactctgcgtgacgacgtggctggtcacaacgttccgggtccagacgttttcgataagctcgtcccggctaagcacttcccccggatggcgggcaaaaaagaccagaagatcgattaaacgcggttcaagggtaagctggcgccccttcctgctgatttggtttacagagggggttaccagccattcaccgacgcgaacaacaggttgtagcatacaagaaagccccagacaaaaagggaaaggcgcgatgataacacatttgtcctacctatttttgccaggggtcactccctcaggcattaggccggaattggctctttat

SEQ ID NO: 157 - DNA, 762 bp, Klebsiella pneumoniae
cagatcaaactccggcagacggatcatcatcacgatgccgtaggctcccaccttcttctggtcttccagcagcgtggccagctgattgtcaaaaaacaggcggttattcagtccggttttcgaatcctgcgccgcgtaggagcgaataagcgtatccatccggctgcgctgatcgctggcgaactgcagctccgacagcagcatatccagcgcgctactggtgctggccggccattcatagaccgacccgcgcacctgcggcccgcgctcgccgctcaggatacgcgtggaacgcagctccagcagctcctggccggccagctggcggcggatccagcggacggcgaagaaaataatcaccaccatgaagccaatggagatcgacagcggggcagtgatcgacagcgaacggaaatagttcaccatcgggtcaacgtagaccagatgcagcgtaatgccaggatgtttaagcgacggaaccgtgatctcacggaattgctcatggctgccgagcgggcgatagctatcgggtcgggaatggctgtagagcggtttgccgttgagcatgaaatcgatatgcacgatctcgatcggcgtcatcagctcatccaactgcggttcaagcttatcgaaagaggtggtgatgagccggttatccagcatggtcgccaccgcctgaacgcggttttcgaccttgttctcaatgccgttataaaaactcagcgaagcgccaatcagcgtgacaaagatggtcaggctagt

SEQ ID NO: 158 - DNA, 858 bp, Klebsiella pneumoniae
gacttcggcagcgtcggctttcaggccggcggcttccagcgcgtcgcgcacagcgcccatctcttcccaggcggtgtagacgtcgatggcgccgtcgtcataggtcaccacgtcttctgcgcctgcttccagcgccgcttccatgatagtgtcttcatcgcctttctcgaaggagataacgcctttcttgctgaacaggtaggagacggaaccgtcggtgccgaggttacccccggttttggtgaaggcgtgacgcacttccgcaacggtacggttacggttgtcggacagacattccaccatcaccgcggtgccgccaggaccgtagccttcataaatgatggtttccatgttcgcgtcttcatcgccgccgacgccgcgcgcgatggcgcggttcagggtgtcgcgagtcatgttgttagacagcgctttatcaacggccgcacgcagacgcgggttggaagccggatcgccgccgcccagacgcgcggcggtgaccagctcgcgaatgattttcgtaaagattttaccgcgtttggcatcctgtgccgctttgcggtgtttggtgttggcccatttactatgacctgccataaaaaactctccaaaaagcgcgccctttcaggcggcgttaattacaaattcttcaatcgcctgccggttgctccacgacttggtcagcgcagcggcttccgtcgcgctgacccagcgataggccagatgttcggtgaaagtaatctcccgctcatgaggcagcgcaagacagaaccagaattccgtattgcgctctacacccggcgcatagcgatgacgcaaatgagaaaatatctcgaactccaccgtgcgctgacagtcgat

SEQ ID NO: 159 - DNA, 153 bp, Klebsiella pneumoniae
tcactcgctgctggcgccgttcgcgttcgtccggcggcagctgctttccgccgccgagcaggcgatcgcgcagatgggcgtcggccttcgccagctccggcaccggcggctggtgcgagagtccgcccgagccgaggatcagcacccgcttat

SEQ ID NO: 160 - DNA, 300 bp, Klebsiella pneumoniae
tttatagccctggcgcagagcctcaataccggcctcgctctgcgcgtcatgcccatggatcaccatcagcgccttgctctgctcccgcaccacctgaccattctggccaagccactggccgtgggcatcaaacaccgtcagcccgtcgcgaaagcgcggcgtgacgtcacggtcgacaaactgttgccactcttcagcggtgatgtctttccccgccgggcggctcagaccgaagtaaagcgtggtttgcaccatggacttatccgccgggcagacgccgggcttcggcgcgctggtcga

SEQ ID NO: 161 - DNA, 204 bp, Klebsiella pneumoniae
gcgtcggaattcggccagcccccagccatagcgttggcagatactgcgcgatgctcactgagaagcccaccgccagggcggtcagcagtgggcgagttagcgaaggcagggttagcaaccagaaaatacgcgtggatccccagccgagcgtgcgggcgacaaccgtcagccgcggatcgcgctggcgccaggccgggcgcaaaa

SEQ ID NO: 162 - DNA, 321 bp, Klebsiella pneumoniae
atgtcgaatgaccgcgtccggcggtcagccgcttcgcttactttttgttcatcatcgctttcagatcggcaaacgggttgtaggtggcctcgccgacgctcttttgcgcatcttcccctgccaccaccgtggagccatactgatcggcttcggtgtacttggaatgttcgtgatcgtgacagtacaggcacaacatctcccagttgctgccatcttccgggttattggagtggtcgtgatcgatgtggtgcaccgtcagctcgcgcagattggagtagacaaactcccgtgagcagcgtccgcacacccagggaaaaagct

SEQ ID NO: 163 - DNA, 216 bp, Klebsiella pneumoniae
tcaccgtccgctggttcaccacagacagattgtaaaacagcggcaggcgtaccagacgctcgctctcctgagtggtgtagcggtcttcaccgcggaattcgccgaactgttcgcctgccgggcagctgtgcaggggaatgtaatggaataccgcgaggatctccgcctctttcagccaggcgatcagtctgctgcgatcctcgatatcacgcagct

SEQ ID NO: 164 - DNA, 78 bp, Klebsiella pneumoniae
agcgatcgaggtcgacaaacgccaggctcaccggctcatggcggcgctgggccgtcagcagggcatactctgccaggg

SEQ ID NO: 165 - DNA, 132 bp, Klebsiella pneumoniae
cgccacagccattccaccggcccctggcggaagcggcgcagccagagcgatgagacaaggaggttaacggcccagatgggggggacaaaggccagcagctgcagacgatcgaagcgcataaacagcccaaga

SEQ ID NO: 166 - DNA, 315 bp, Klebsiella pneumoniae
ttttttcggcagctgtacttcaacggcgtcggcgttccgctttttcagttgctgggcaatcgcccactcaatgtgttcgtcgagaagcgggtgctcgccccggcggctctccagggcgcgaagatgggcttcatcccagggcgcattgcccaacgcgacggcgatattacgcagccagcgcaggtggccaatgcgacgaatcgccgacccttcggtcaccttcagaaaccacgcttcgctccaggcgaacagctccaccagcggcggggcatgcagcgctttgcgtgggctgaaatcctcttcatcggtgagctg

SEQ ID NO: 167 - DNA, 561 bp, Klebsiella pneumoniae
gccaatcccgataggaatcgaggcggtcattgcgctgaggatgatcaagggaccgaggaagcggccggaggcgttaccggcccccatcatcacgtcggcgccgtaggtggaatcgctctggttgatggtgaacttacgcgccagaatgatgatgtagcccaccgccaggccgaggaccaggccggtgaccagcgacgcggcgaagttcgccaccgggaagacaaagcccgcgccgagcagcagcgccggcacgccaagaccgataccggtctgtatcgcgccgccgatatcgaggatccctaccagcgacccttcgatgatgcgggcgaacaggaagctggcgccaaacgccgccaccgcgccgtaaacgccggtatcaatccccgacttcagcatcgccacgaaggccacttcgttaaaggcgccgatgccgtacaggtagtacatgtgggtcccggcgaagacgccggaggagagcaggccaacaaagatcgggaacgaccagtcggcataccaaaaacctttattctgttccattatccggctcccgttacttgccgc

SEQ ID NO: 168 - DNA, 360 bp, Klebsiella pneumoniae
atgacctcgaaaaccgcccggcggcgacgccgggcagcgaagagcagcagtaaaaaacgggcccctgggggcccgttttgcgtttggcttaatgggcggcttccgcctgactactcacctggcgacagtacagttcatagcgctggcaaaaccattcacgatgttcttcatccatattgccgacaatggcctgaagatcaactggctggccctgggcgtgcattctggcgaaactccgcgccaaaaaatcaaaattcttcattgaatacatatcgttatggttcatgcgcatactccttcagcggtggatgttctgatcagtcatatgccttttactcacttcagtatttacgcttacct

SEQ ID NO: 169 - DNA, 147 bp, Klebsiella pneumoniae
acactaacggtaacgcgaccagcatcaccagggcggcaagggtcgcgccggaaaggaatgtttgtttcacaaccggttcctgaagctgagggtcctccggcggccagcgccggagaaacgggatcaattactgcgcgtacagctgac

SEQ ID NO: 170 - DNA, 231 bp, Klebsiella pneumoniae
tggtgccgcctttcccggcgccgtcccggccttcaaagacaatgcacactttcagtcctttgtgtaccacccagcgctgcagtttcaccagctcaacgtggagtttgcgcagcgctttctcgtacgctttgttgtcgagcggcgcgatttttgccgccgtgtcgaccggattaccgcttttcttgttgcccatcgccatgctccgtgttgccgaggtatccctttgaagtg

SEQ ID NO: 171 - DNA, 339 bp, Klebsiella pneumoniae
aacgataccagcgacaacaggttaagtgtgggggtattacggattaacaaaagtccgttttacccgctgcgaacggcgaaaatagggcgccagcagcgcagcgcccagcagcggaaacagcagctgacgcagggcaagcacatccgagaccggcgagaaggcaaaagcctttatcgccagcagcagggtgatgagcagccagataatatagtgtttcggcaccaccgagcgccgcttgaaaaaggcgatagtcagccagagcgtgtaataccacatggcgagggcaaacagcagcgaggcgacccacagcgccatatggcccgcgctcatggcgcgcag

SEQ ID NO: 172 - DNA, 396 bp, Klebsiella pneumoniae
aaacacacggccaaagcgggcttcgtagcgggcattgccctcccgcagggcctgcgcgagccgctcattctcgctgtccaccgacgactgctcctggcgcgacagcgccgcatgcgcctggctgccggtcggcttctcaccgatccgcggatgggcgctgagcgccgcgttcagctcatcctctccccagttagccatcgcctcccgggcggtctgcagcagcgcatggcggctggcgaaaggtcgcaagctcaccagcgtctcgccccaggccgggagcgccacgcagggggccagcagccccgccgcctcatctttactcaggctgttaaactgactcagcgcgatcatcctgactccttatcgttttcgtcgccgcctgctcctgcggcagaa

SEQ ID NO: 173 - DNA, 231 bp, Klebsiella pneumoniae
tccttgcaaagctgcgccatattgagcgtggtttgcggcgtaatacgagcgcgctgcgctttttgcgtcggcggggagacggtctcgctgcagcccgcgaggagcagcaccagcatgacggaaacaacacctttcaccacgttctcctccaccgccttgttagcaagttgttatcctaaagattcagtattacaggtattttgcgaatatcatgaaactgcgacaagtctg

SEQ ID NO: 174 - DNA, 498 bp, Klebsiella pneumoniae
acgtcaatccgacgggcttcatcgagcatcgaggctttggcgcggatccgcgcttccagctggtcgatcatgtcgttgttgtccaggcgatctttacgcacgccgtcttcatacaggccgcttttcttgttgccgccggtgacgccaagggtggagaccagcgcttcgcccgggccgttcaccacgcaaccaatgatcgaaacatccatcggggtgatgatatcttccagacgctgctccagagcattcaccgtaccgataacgtcaaactcctggcgtgaacaggtcgggcaggcgataaagttaatgccgcgggaacgaatacgcagagatttgaggatatcgaagccgaccttgatctcttccaccggatccgccgccagcgagacgcgcagcgtatcgccgatcccctcggacagcagtagtcccagaccgatcgccgattttaccgcgccgctgcgcgcgccgcccgcttcggtgatcccgagatgcagcggc

SEQ ID NO: 175 - DNA, 312 bp, Klebsiella pneumoniae
cccgcgcgggcaggctgtgcgccgccacgacgttttccaccagttccaccaggtccaccgcttcgcgagccaccgggccgtcggcctgttttcggttatagtccagcagctgttcaatcagcttttgcaggttacggctactgctgtcgaggatctcgacaatctcctgctgctcaggggtcaggggccccgcgacccggtcggccaacagctcggtaccttcacgcatactggccaacggggttttcagctcatgcgacagatggcgaagaaattgatgccgctgcgactccagccacgccaggcgctcgc

SEQ ID NO: 176 - DNA, 78 bp, Klebsiella pneumoniae
actgctccaggtatgccaccagcgcgtcgcggtagttggcgcgcgcttccagcgaaccgatggagttcagctccaggc

SEQ ID NO: 177 - DNA, 423 bp, Klebsiella pneumoniae
ctgcggattgatgttaaacagcaggccggcgaagaaggtggccaccgcccagcccagcgagccccacatccgcgccctgccgaattcaaactggctctgacgcgccaccctctcggtgtaagattccagcacgccgatgccgccgttaaaggtcaaaccgatatagatcccgccaaagatgctgcccaacaggacgttgattttcagcaggtggccgaacagcagatacgccggaccagagaggatcagcagcgcggtgatataccagagcagatgtttgcgcagccccagcttgtcctggataaatccatagcaaacttgcgcaaacagcgcggaaaccgacagtacggcatagataataccggtatcgccagccttcagcccaacctcctggtgaagccagatagagagcaaggagccgga

SEQ ID NO: 178 - DNA, 225 bp, Klebsiella pneumoniae
tgtcgtggtgcaccagcttctcgttctggatgccgacgcaacggccgccatggccctgcagcagcagctcaatcgcataggcgcccatgcgggaagccaggatgcggtcgtaaggaaccggggaaccgccgcgctgaatgtggccgaggacggtggcgcgagtttcacggccagtctctttctcgatatagcttgccagctcgtcaacgtcgcacatgtgctcgg

SEQ ID NO: 179 - DNA, 204 bp, Klebsiella pneumoniae
gtggcgcgcagaagctgcgcggttttcaggaagtcggcgctaagcatttcgactttcgcgccgcggctgccgggtagcagagcgaggcagcgcacgctgtgcgggatccctaaccggtcgcgcgcagcgcctttgtcaggatccagcggcatcgcatccgccatggtatggccaataaagcggcaggggacgttaaatttgtca

SEQ ID NO: 180 - DNA, 144 bp, Klebsiella pneumoniae
cccaacgcaccgcgatgtcaccaggtaaattcgcatttacccccagcgtccaggcggcatctttccgctgcgcccgggtttcgaaatgcaccacctggccggtgccatggacgccggcgtcggtgcggccgggccaaaagacgg

SEQ ID NO: 181 - DNA, 477 bp, Klebsiella pneumoniae
ccgccagatggttttcaaaggtggcctgcggatgctgatcctgcagggttcgaccgaatgaagaaccgcggtgatgagcaagcccttccaggtcgataccgtccgggcgcgagcaaaccagctgagttttgccgttgccggtacagccgccaatcagcacgatcggccgctgcaccagttcgtcggtggcctggatcgccgcctggcgtagcgctttatagccgccgacgatcagggggtaatccacgccagcttctttcagccactgctggacgatatgcgagcgctggccgccgcgggcgcagcacaggtaaccgtgtgggtaacgggcgcacgcttccagccacgcctgagtacggctggcgcgcaggtcaccctggaccagtttatggccgagcgccagcgccgcttccggcccctgacgcttgtagcaggtgccgaccgcggcgcgttcttcatcattcatcagcggcaggt

SEQ ID NO: 182 - DNA, 303 bp, Klebsiella pneumoniae
tgctcctgcgggtttttcccggtcaccgcggtgatttccgccgccagcaggcacatgatgatgccgtctttatcggtggaccacggcgtgccgtcgaagcgcaggaaggaggccccggcgctctcttcgccgccgaagccgaagctgccatcgaacaggccgtcgacaaaccacttaaagcccaccggcacttccaccagcttgcggcccagatcgttcaccacgcggtcaatcatcgcggaggagaccagcgttttacccaccgccacctctttgccccactgcggacgatgctggaacagg

SEQ ID NO: 183 - DNA, 255 bp, Klebsiella pneumoniae
cacaccaccgccagcaggataccggccactttaccaatcggggtgctcaggctttcaacgccgccgccgactttcgccagcgccaccaccgtcagcaccggcagacccaccgcagtgatcaggaagccgatcgccgccgtccagacgtgctcgcccgcctgtaagccaaccatcggagggaaaataatgttgcctgcgccaacgaacaacgcgaaggtcataaagcccaacgctatgatgtcgcgagattttaac

SEQ ID NO: 184 - DNA, 501 bp, Klebsiella pneumoniae
tcaggcttcccagctcgcgccgacgctttttattacgcatctgcatctggtgcagaccatacagcagcggctcccaactgccgcggccaggcggaggagtcatgctccggtccacccacagccaccacgacaggcgcatcaaattccagaaatgccagatcagcaaaccggtcactgccgccagtaaaaaccacggcagatgccccacaaacgcccccagaatcagggccggaatacacgctaaaaagagctccagcgccagccttttccatgacagccgttccagcacgggtcacactcctgtcaaaattcagaaacgggcggagaaacgataccccgtgccgcgaaccgtttgcaccatacgatcatggccactgtgttccagcgctttgcgcaggcggcgaatatggacgtccaccgtgcggtcttccacataaacgttggtcccccagacgtggttcagcagctgttcgcggctgtacacccgctccggatgggtca

SEQ ID NO: 185 - DNA, 315 bp, Klebsiella pneumoniae
aagcacgacagtaataacaaaagaaattttggcggaacgtttccctgcttcgagggtttcgtcaaggtagccaaagtccatcatcagatggcgaataccgacaacgacgtgataggccagcgcggtgagaatgccccacatgatgaacttcacaaagaagctatccatgatggaggccgccgtcagaaaaccttctggggaggaaaggctggtgcccagcagccaaagcagaattccgaccgccacgaaggtgatgacaccggaaacgcgatggagaatggacgctatcgccgtgattgggaaccgtatcgtttg

SEQ ID NO: 186 - DNA, 486 bp, Klebsiella pneumoniae
agcgtcgccatcagccccggcgtacgctgggcggcggtcaggatcgccgcgcaggccaccggattgcgcttatgcggcatcgtcgacgagccgccgcggccttccgccaccggctcgccgacctcagccacttcggtctgcatcagcagggagaaatcgttagcgaatttccccagcgtgccgcagacgccggcgaaccaggcgcccgcctccagcagccgatcgcgctggctgtgccacggagtatccggcagcgacagaccgaggatctgcgccagcgccaggccaaccgccggccctttctcttttagcgcgtccagagtgcccgcggcgccgccgaactgcagcgccagcagtcgcggacgcatctcgcgcagccgctgctgccagcgcaggagcgcgtcgagggtgcccgccagcttcaggccaaaggtcaccggcagcgcgtgctgcatccaggtccggcccggcatcacggtatcgcga

SEQ ID NO: 187 - DNA, 348 bp, Klebsiella pneumoniae
cctccgccagcgccggctccacctccgccaaccgcttcgcttccagcagctgatacggcacgccggcgtcctccagcaccgcgatgtcgcgggtggcattttcatactgtttggcggtacggaacagctgcagcgtcccgccctggcgcccttcatactgaatgccggtggtgtcgcgcagcgccttcaggcagtcgcggctgtactccgccaggcgcaccatacggcctttgttctccatatagtggcgggtgtcgcagttgcgcagcatctgccacatccacttcaactggaacgaggtgccgtcaagaccgatcgccagcggcgcatggcgctgaaacatccatt

SEQ ID NO: 188 - protein, 129 aa, Klebsiella pneumoniae
FSYIMLGTNDLPRAIKFYDPLMALLGHVKAGRNEQGASWGTFNGNHTCGLCVGVPFDQQPAGVGNGTMVALNARSVAHIAELHALALQLGGRDEGGPGHRPQYGDGFHSAYVRDPDGNKLAFVYYASAD

SEQ ID NO: 189 - protein, 331 aa, Klebsiella pneumoniae
ADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 190 - protein, 179 aa, Klebsiella pneumoniae
LLMQRITKLDNDLTCKGMLMKLWNKTLLASALCLTLFGCDDASKVDNKLDKAKDNAEQMKDAAADKAQAIKQDADKQIDTLKSQADAEADRLKDQASAIKAEADKKADAIAQQAKAQADAVKQNAKQESDRIVKEAGQIKDNAIGDANQLSAEAASKTKAIQDSIAKDKQNAAPPAAQQ

SEQ ID NO: 191 - protein, 168 aa, Klebsiella pneumoniae
VPVTEPSSRRSGYARLLDRAIRILAMRDHSEQELRRKLVAPVMSKNGPEALDVTPDELEQVVAWCIENRYLDDNRFVGQFIASRSRKGYGPARIRQELSQKGIARQVVDQAMRECDIDWVSLAREQAQRKYGEPLPSAFTEKVKVQRFLLYRGYLMEDIQEIWRNFAD

SEQ ID NO: 192 - protein, 419 aa, Klebsiella pneumoniae
SKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPD

SEQ ID NO: 193 - protein, 434 aa, Klebsiella pneumoniae
GVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 194 - protein, 518 aa, Klebsiella pneumoniae
VTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVS

SEQ ID NO: 195 - protein, 245 aa, Klebsiella pneumoniae
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTNND

SEQ ID NO: 196 - protein, 680 aa, Klebsiella pneumoniae
VKSLRAWPSTVRTGVKMSSRKELANAIRALSMDAVQKAKSGHPGAPMGMADIAEVLWRDFLNHNPNNPAWADRDRFVLSNGHGSMLIYSLLHLTGYDLPIEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLVAFYDDNGISIDGHVEGWFTDDTAKRFEAYGWHVVRGVDGHDADAIKRAVEEARAVTDKPSLLMCKTIIGFGSPNKAGTHDSHGAPLGDAEIALTREALGWKHAPFDIPSDIYAQWDAKEAGQAKEAAWNEKFAAYAKAFPQEAAEFTRRMKGEMPSDFDAKANEFIAKLQANPAKIASRKASQNAIEAFGPLLPEFLGGSADLAPSNLTLWSGSKPINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAIAWKYGVERQDGPTALILSRQNLAQQERTAEQLANVARGGYVLKECTGSQPELIFIATGSEVELAVAAWDKLTAEGVKARVVSMPSTDAFDKQDAAYRESVLPKAVTARVAVEAGIADYWFKYVGLNGAIVGMTTFGESAPAEQLFEEFGFTVDNVVAKAKALL

SEQ ID NO: 197 - protein, 306 aa, Klebsiella pneumoniae
EVKIALVAKSLGNGFFEAANVGAQQAAKELGDVKVIYTGPTTTTAEAQIDVLNGLIAQGVDAIAISANDPDAVVPVLKKAMQRGIKVVSWDSGVAPAGRQIHLNPSNNALIGETNVKLAADALQALNVEKGEVAVLSATPTSTNQNIWIEEMKKVLPQYPSVQLVTVAYGDDLSDKSYREAVGLLKSYPDLKVIVSPSSVGIVAAAQAVKDQGKIGKVYVTGLGLPSEMAGAIKSGASKSFAIWNPIDLGYAATYLADDLVKGTATKTEASMGKLGKVNLDAEGNGAMAKPFVYDASNIDKFSKIF

SEQ ID NO: 198 - protein, 226 aa, Klebsiella pneumoniae
ANKTLVVATDTAFVPFEFKQGDKYVGFDVDLWAAIAKELKLDYTLKPMDFSGIIPALQTKNIDLALAGITITDERKKAIDFSDGYYKSGLLVMVNANNNDIKDVKDLNGKVVAVKSGTGSVDYAKANIKTKDLRQFPNIDNAYMELGTGRADAVLHDTPNILYFIKTAGNGKFKAVGESLEAQNYGIAFPKGSDELREKVNGALKTLRDNGTYNEIYKKWFGTEPK

SEQ ID NO: 199 - protein, 334 aa, Klebsiella pneumoniae
RFIWLYTELKNAPTLKTYSAAVDWNVPGHYFAETFSRSGMNPSGQSIRGEIMKKSLASMCLSAVLTVAFSYHAVAADLPEIEKSGTLKVATEDDYAPFNFMNNGQADGFNKDMLEELRKYAKFHVDQSILPWTGLLAAVSTGQYDMALTGAVITDERLKVFDFTPPWASAQHYFVKRAGDTSLNTIADLSGKKVGVQAGSALLARLPELKAMLEKTGGKLGPVVEYPSYPEAYADLANKRLDYVINVVISVNDLAKAKPKVFAKGLAVSGPGYMAWPIPKNSPQLLAYMTRFMNHMKETGKLAELQKKWFGETYDNLPTEAITSPEQFHKLAGL

SEQ ID NO: 200 - protein, 596 aa, Klebsiella pneumoniae
NLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 201 - protein, 717 aa, Klebsiella pneumoniae
AETATDDKNSAAEETMVVTAAEQNLQAPGVSTITADEIRKRPPARDVSEIIRTMPGVNLTGNSTSGQRGNNRQIDIRGMGPENTLILIDGKPVTSRNSVRLGWRGERDTRGDTSWVPPEMIERIEVIRGPAAARYGNGAAGGVVNIITKKTGDEWHGSWNTYMNAPEHKDEGSTKRTNFSLSGPLGGDFSFRLFGNLDKTQADAWDINQGHQSERTGIYADTLPAGREGVKNKNIDGLVRWEFAPMQSLEFEAGYSRQGNLYAGDTQNTNSNDLVKENYGKETNRLYRNTYSVTWNGAWDNGVTTSNWAQYERTRNSRKGEGLAGGTEGIFNSNQFTDIDLADVMLHSEVSIPFDYLVNQNLTLGSEWNQQRMKDNASNTQALSGGEIPGYDSTGRSPYSQAEIFSLFAENNMELTDTTMLTPALRFDHHSIVGNNWSPSLNLSQGLWDDFTLKMGIARAYKAPSLYQTNPNYILYSKGQGCYASKDGCYLQGNDDLKAETSINKEIGLEFKRDGWLAGVTWFRNDYRNKIEAGYAPVYQNNKGTDLYQWENVPKAVVEGLEGTLNVPVSETVNWTNNITYMLQSKNKETGDRLSIIPEYTLNSTLSWQVRDDVSLQSTFTWYGKQEPKKYNYKGQPVTGSEKNEVSPYSILGLSATWDVTKYVSLTGGVDNVFDKRHWRAGNAQTTGGATGTMYGAGAETYNESGRTWYLSVNTHF

SEQ ID NO: 202 - protein, 404 aa, Klebsiella pneumoniae
VDFHGYARSGIGWTGSGGEQQCFKATGAQSKYRLGNECETYAELKLGQELWKEGDKSFYFDTNVAYSVNQEDDWESTSPAFREANIQGKNLIDWLPGSTLWAGKRFYQRHDVHMIDFYYWDISGPGAGLENVDLGFGKLSLAATRNSESGGSYTFSSDDTKKYAAKTANDVFDIRLAGLETNPGGVLELGVDYGRANPQDDYRLEDGASKDGWMWTGEHTQSIWGGFNKFVVQYATDAMTSWNSGHSQGTSIDNNGSMIRVLDHGAMDFNDDWGLMYVAMYQDVDLDSKNGSTWYTVGVRPMYKWTPIMSTQLEIGYDNVKSQRTSENNNQYKITLAQQWQAGNSVWSRPAIRIFATYAKWDENWGYSNTSGLQTKDSSGSGAFTSSRGDDSEVTFGAQMEVWW

SEQ ID NO: 203 - protein, 632 aa, Klebsiella pneumoniae
MAIEIKVPDIGADEVEITEILVKVGDKVEAEQSLITVEGDKASMEVPSPQAGVVKEIKVSVGDKTETGKLIMIFDSAEGAAAAAPAQEEKKEAAPAAAAPAAAAAAKEVHVPDIGGDEVEVTEIMVKVGDTIAAEQSLITVEGDKASMEVPAPFAGTVKEIKINTGDKVSTGSLIMIFEVAGAAPAAAPAQAAAPAAAAPAAAAGVKDVNVPDIGGDEVEVTEVMVKVGDKVAAEQSLITVEGDKASMEVPAPFAGTVKEIKISTGDKVKTGSLIMVFEVEGAAPAAAPAQAAAPAPAAAPAQAAKPAAAPAAKAEGKSEFAENDAYVHATPLIRRLAREFGVNLAKVKGTGRKGRILREDVQAYVKEAVKRAESAPAAAAGGGIPGMLPWPKVDFSKFGEVEEVELGRIQKISGANLSRNWVMIPHVTHFDKTDITDLEAFRKQQNAEAEKRKLDVKFTPVVFIMKAVAAALEQMPRFNSSLSEDGQRLTLKKYINIGVAVDTPNGLVVPVFKDVNKKSITELSRELTTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 204 - protein, 257 aa, Klebsiella pneumoniae
MDRIIEKLDRGWWVVSHEQKLWLPGGELPHGEAVNFDLVGQHALHIGEWQGESVWMVRQDRRHDMGSLRQVLDQDPGLFQLAGRGIQLAEFYRSHKFCGYCGHPMHASKSEWAMLCSHCRERYYPQIAPCIIVAIRRDDAILLAQHTRHRNGVHTVLAGFVEVGETLEQAVAREVMEESGIRVKNLRYVTSQPWPFPQSLMTAFMADYADGEIVVDKKELLTADWYRYDDLPLLPPPGTVARRLIEDTVAMCRAEFE

SEQ ID NO: 205 - protein, 130 aa, Klebsiella pneumoniae
MFSYIMLGTNDLPRAIKFYDPLMALLGHVKAGRNEQGASWGTFNGNHTCGLCVGVPFDQQPAGVGNGTMVALNARSVAHIAELHALALQLGGRDEGGPGHRPQYGDGFHSAYVRDPDGNKLAFVYYASAD

SEQ ID NO: 206 - protein, 587 aa, Klebsiella pneumoniae
MNVLRRKWQGLPRGVVVCITALVIYVPLLFIVVQSFLSAPFFSRSKSWSLEAFAFIFTDPDFYLALRSGFILAFGLVIIAIPLGGILAFLMVRTDLPGRRIIEPLILVPIFVSPMVLGFGYVVAAGPVGFFSQWAQQLIGFVPWNIYSMFSIVVIAGLTHVPHAYLYISSALRSVGSDVEEAARTVGATPLQVMTSVSLPMVRPSILYACVLLFFLGLEVFGLMLVLGDPEGNMVLATYLYKLTNKLGTPSYHLMAAVAVVLICITIPLVMLQRRLMRTANRFVTMKGKASQARALPLGKWRWVAGAVVVAWLTVTIGVPLLGVALRAFISNWGVGVSLWDELSLATFHNIWQQPNLLRAIVNSMAIGIIGGALAVICYLFVGIAMHRKADNVTRFLDYSVLVPRAVPGLLAGLAFLWVFLFVPMWLDQSLKHGWLSALRWPTGCGSTLSCSCALRNTIFSVWLAYTVVWMATLRLISSTLLQVGPELEEAARSTGASRGQITRHVTVPLSRYGLIGSWLLMFLIFEREYSTGVYLLSPGTETIGSMLVSLWAAGAIDIVAALSFINILLVVIGLGIALRFGVKLHD

SEQ ID NO: 207 - protein, 301 aa, Klebsiella pneumoniae
MQDLNDFAWFVQVVDHGGFAAAGRALDQPKSKLSRRIAQLEERLGVRLIQRTTRQFAVTEVGQTFYQHCKAMLIEAEAAQQAVETLRAEPRGSVRITCPVTLLHVHIGPMLARFMARYPGVTLHLEATNRRVDVVGEGIDVAIRVRPRPIEDSDLVMRVLADRGHRLVASPDLISRLGRPQAPSELSAWPGLSLGANKHQHKWQLTGPGGARAEVYFTPRMVTTDMLALREAAMAGVGVVQLPLLMVRDQLASGELEVVLDEWQPRREVIHAVFASRRGLLPSVRALVDYLSEEYQRMEED

SEQ ID NO: 208 - protein, 381 aa, Klebsiella pneumoniae
MSGANASGYLESRTMKTETPTVKMVAIAADEAGQRIDNFLRTQLKGVPKSMIYRILRKGEVRVNKKRVKPEYKLEAGDEVRIPPVRVAEREEEAVSPHLQKVAALSEVILYEDDHILVLNKPSGTAVHGGSGLSFGVIEGLRALRPEARFLELVHRLDRDTSGVLLVAKKRSALRSLHEQLRDKGMQKDYLALVRGQWQSHTKVVQAPLLKNILQSGERIVRVSQEGKPSETRFKVEERYEFATLVRCSPVTGRTHQIRVHTQYAGHPIAFDDRYGDREFDKQLSATGLNRLFLHAAALKFTHPGSGEVMRVEAPAGQPAEALFTGATEEQISATRNQFRRFFCLSLTAGCSFHGATSDRARLRVNRPGCSGRGLPAVRTA

SEQ ID NO: 209 - protein, 842 aa, Klebsiella pneumoniae
MNKITKYIDALPLSDAEKSALPDTSLQAVHQALDDDHQTFAREDDSPLGSVKARLAHSWPDSLSGDQLVKDDEGRTQLHAMPKAKRSSMIPDPWRTNPVGRFWDRLRGRDVTPRYLSRLTQEERESEQKWRTVGTIRRYILLLLTLSQTVVATWYMKTILPYQGWALINPADMVGQNLWISFMQLLPYVLQSGILILFAVLFCWVSAGFWTALMGFLQLLIGRDKYSISASTVGDEPLNPAHRTALIMPICNEDVDRVFAGLRATWESVKATGNAAHFDVYILSDSYNPDICVAEQKAWMELIAEVQGEGQIFYRRRRRRVKRKSGNIDDFCRRWGSQYSYMVVLDADSVMTGECLSSLVRLMEANPNAGIIQSSPRASGMDTLYARCQQFATRVYGPLFTAGLHFWQLGESHYWGHNAIIRVKPFIEHCALAPLPGEGNFAGSILSHDFVEAALMRRAGWGVWIAYDLPGSYEELPPNLLDELKRDRRWCQGNLMNFRLFLVRGMHPVHRAVFLTGVMSYLSAPLWFMFLALSTALQVVHALTEPQYFLQPRQLFPVWPQWRPELAIALFASTMVLLFLPKLLSIILVWCKGPKEYGGFFRVTLSLLLEVLFSVLLAPVRMLFHTVFVVSAFLGWEVVWNSPQRDDDSTPWGEAFMRHGSQLLLGLVWAVGMAWLDLRFLFWLAPIVVSLILSPFVSAISSRATVGLRTKRWKLFLIPEEYSPPQVLKDTDAYLTMNRQRSLDDGFMHAVFNPSFNALATAMATARHRQGHILEIARERHVEQALNETPDKLNRDRRLVLLSDPVTMSRLHYRVWAAPEKYSSWVNAYQQLALNPLALKTK

SEQ ID NO: 210 - protein, 200 aa, Klebsiella pneumoniae
MEMAKILVLYYSMYGHIETMAHAVADGANRVDGVEVVVKRVPETMQAEAFAKAGGKAQNAPVATPQELAEYDAIIFGTPTRFGNMSGQMRTFLDQTGGLWASGALYGKIASVFSSTGTGGGQEQTITSTWTTLAHHGMIIVPIGYGAQELFDISQVRGGTPYGATTIAGGDGSRQPSEEELAIARYQGEHVAKLAVKLHG

SEQ ID NO: 211 - protein, 773 aa, Klebsiella pneumoniae
VEQHAGDFSVTVRDVRQLTQPESDLLTLLWVLEGSVNLAVAEGASQPLAADGLAIVNRNRRWSLRSAGANAVMILTLSANWLARLDNAFFAVDYQITPRTRDADDGLRRLMRQLLVSGLVNHPGHYRLEANRWLSEIALLLATRFSQPIASTPRRDTEKWSRRIASVVARIDANYQRRLSLHEVAAAEFVSEAWLSRLFRKEVGVSFVQYLTALRLRHAADQLLTTRKTVQQIAREQGFASTRMMSDLFKRQHGVTPRQYREQHPLELARPRPPQADRWQPVAADRLYARLNEPEPRDRESPPLPINPPQTREINLRDRPARPAALRHTRMVVTVRELDDLLREDVRRELEQLHHALPVYAIDINDPFLSSRLFGTGWDDPQMAGYACWYNLQQIFSWLAAMGWQVILHTGVTTRSDLLQRFLQLAANHFPPATLNSWRFVWHWSPQASEAARQAAWRQQRGVLHRLLPQPQLGIWHRFAPSDPGNDPLFHSPLLAEADFLACQADANEQLDLAQADSSRLASSEHYPLHKLRQIHSALRQRQLNLPLWLLSWNTLTGDTRDTNGRFFRGALLMDNLLGVADQVWLAGFWLNSGLQGEARANGKLDTSSLALHYLHGLPRPVYWVLWLWRRLRGEILVHDKNLLLLHHQGHYQLLLRNTVVYNPWLSSEAAFIQRFSQLYSVRLQGLDGSWRIKQHLFDQHHGALFPLVDAFRSRSGPDAEDYQWLMHQARPALSVDEARLDGYWLRIDSLQSNALVLYEFTPQLSSGADPAP

SEQ ID NO: 212 - protein, 315 aa, Klebsiella pneumoniae
MKAAVVFDLAEGPVWAEFIDPQPAPGQTLIDVRAAAISHVVKARASGRHYSFDGNLPFVPGIDGVGTTPQGQRVYFAFPTAPFGSMAQRAPVALQNCLPLPDALDDIQAAAMANPGMSAWASLVTRAQLQAGETVLINGATGSAGQLAVQIARYLGAKKIIATGRNAQSLAALDADECIQLTADDKTLSGQFSAVSAAQIDVVIDYLWGHSAELLLPALAKYTPAGSPVRYVQVGSLAGADIALNGAVLRSAPLLLMGSGIGSLSVSQLLAATGEMLQAAVPGKLTIATTPRPLQEIAAAWPQDDSQKRTVFTLG

SEQ ID NO: 213 - protein, 482 aa, Klebsiella pneumoniae
VDLSIIISAVIALAAGLMVGWLATKARADQIRADLIEERRELDIELSAARQQLAQEAHWREECELLNNELRSLRDINTSLEADLREVTTRLESTQLHAEDKIRQMMNSEQRLSEQFENLANRIFEHSNRRVDEQNRQSLHGLLTPLREQLDGFRRQVQESFGQEARERHTLAHEIRNLQQLNAQMAQEALNLTKALKGDNKTQGNWGEVVLTRVLEASGLREGYEYQTQVSIETDNRSRMQPDVIVRLPQGKDVVIDAKMTLVAYERYFNAEDDYTREVALQEHLASVRNHIRLLGRKDYQQLPGLRSLDYVLMFIPVEPAFLLAIDRQPELISEALQNNIMLVSPTTLLVALRTIANLWRYEHQSRNAQKIAERAGRLYDKMRLFVDDMSAIGQSLDKAQESYRQAMKKLASGRGNLLAQAEAFRGLGVEVKRGINPDLVEQATAQDEQYRLEDEDNLPENDAFSADSAETVRSREAAPPR

SEQ ID NO: 214 - protein, 398 aa, Klebsiella pneumoniae
MLNVEMLSTGDEVLHGQIIDTNAAWLADFFFNQGLPLTRRNTVGDDLDALVAILRERSEQADVLIVNGGLGPTSDDLSALAAATAKGEGLILHPEWLETMTRFFAERGRPMAESNRKQAEIPASAEMINNPVGTACGFAIQLNRCLMFFTPGVPSEFKVMVEQEILPRLRQRFTLPDPPVCLRLTTFGRSESELAQSLNPLTLPPGVVMGYRSSMPIIELKLTGPANQRDAMLALWPEVRKVAGDSLIFEGTEGLPAQIARCLQERQLSLTLSEQFTSGLLALQLSRAGAPLLASEVVPAQEETLAQAARWAAERRINHFAGLALAVSGQENDHLNVALATPDGTFALRVKFSATRHSLAVRQEVCAMMALNMLRRWLNGQPLASEHGWINVVDSLSL

SEQ ID NO: 215 - protein, 315 aa, Klebsiella pneumoniae
MIEFQGVSKVFAGHPAVKDLTLELREGAFSVLVGTSGSGKSTTLKMINRLLEPDRGTIRFAGEDIRQQPVLTLRRRMGYAIQSIGLFPHWTVAQNIATVPQLQRWPRARIADRIDELMALLGLEATLRDRYPHQLSGGQQQRVGVARALAADPEVLLMDEPFGALDPVTREALQQEMLRIHRLLGRTIVLVTHDIDEALRLADHLVLMDGGEVVQQGAPLEMLLRPKNSFVQTFFGRSELGVRLLSLREVGDYLRPDERLAGEGLTVTMTLREALSQFVARRCETLPVVDAEGRPCGTLHFADLLRQEMSHEGAS

SEQ ID NO: 216 - protein, 356 aa, Klebsiella pneumoniae
MKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 217 - protein, 353 aa, Klebsiella pneumoniae
MRPTMMTYISEEPACLAQILRDYRQKLAPIETFVRQHPVRRILLLATGSSLNAALCARYFFEQRFGVLLDIKEPYNFTHYDAIDPHADLVVAISQSGKSASTLEAMRKVQASGKSVFALTSDPQSPIGGASDGVLDINTGIESVGFVTRGFSATVLNLLLIALIIARKQEKASEVEEQHYLAELQRLVAAIPEVIVRTSRFIDRHSETLRSGERFVATGYGALVGVAKEFETKFTETVRVPSSGFELEAYMHGPYLEANARHVMLFIEDTPDARTRALRDYLAPSIGRAFTLTLGDEEDAQTLALNCPCEHHLAPLLLIVPVQMLAWHTAGLKGIDLAKRIFDDFDRVLKSKI

SEQ ID NO: 218 - protein, 938 aa, Klebsiella pneumoniae
MSDYKSTLNLPETGFPMRGDLAKREPGMLARWTDDDLYGIIRAAKKGKKTFILHDGPPYANGSIHIGHSVNKILKDIIVKSKGLTGYDSPYVPGWDCHGLPIELKVEQEYGKPGEKFTAAEFRAKCREYAAEQIDGQRKDFIRLGVLGDWSHPYLTMDFKTEANIIRALGKIIGNGHLHKGAKPVHWCVDCRSALAEAEVEYYDKTSPSIDVAFHAVDKAAVLAKFGVADVNGPVSLVIWTTTPWTLPANRAISLSPEFDYALVQVDGQALILAKDLVESVMKRVGATDYTILAAVQGSELELMRFKHPFLDFDVPAILGDHVTLDAGTGAVHTAGGHGPDDYTISQKYGLEIANPVGPDGAYLPGTWPSLDGINVFKANDIIVEMLRERGALLHVEKLQHSYPCCWRHKSPIIFRATPQWFVSMDQKGLRAQSLKEIKGVQWIPDWGQARIESMVANRPDWCISRQRTWGVPMSLFVHKETHELHPRTLELMEEVAKRVEVDGIQAWWDLDSRDILGDDADSYEKVPDTLDVWFDSGSTHSSVVDVRPEFAGHAADMYLEGSDQHRGWFMSSLMISTAMKGKAPYRQVLTHGFTVDGQGRKMSKSIGNTVSPQDVMNKLGADILRLWVASTDYTGEMAVSDEILKRAADSYRRIRNTARFLLANLNGFDPVKDMVKPEEMVVLDRWAVGCAQAAQEDILKAYESYDFHEVVQRLMRFCSIEMGSFYLDIIKDRQYTAKADSVARRSCQTALFHIVEALVRWMAPIMSFTADEIWGYLPGEREKYVFTGEWYEGLFGLADDEAMNDDFWDELLKVRGEVNKVIEQARADKKVGGSLEAAVTLYADADLAAKLNALGDELRFVLLTSGANVADYASASADAQQSELLKGLKVALSKAEGEKCPRCWHYTTDIGKVAEHAEICGRCVSNVAGDGEQRKFA

SEQ ID NO: 219 - protein, 345 aa, Klebsiella pneumoniae
MTDQPQRHRRWVLASRPHGEPTAENFRLEESEVPTPGPGQVLLRTVYLSLDPYMRGRMSDAPSYSPPVAIGAVMVGGTVSRVVSSNHADYQPGDWVLGYSGWQDYELSDGSGLVKLGDNPQHPSWSLGVLGMPGFTAYMGLLEIGQPKAGETLVVAAATGPVGATVGQIGKIKGCRTVGIAGGAEKCRYAVETLGFDLCLDHRADDFAEQLAKACPQGIDVYYENVGGKVFDAVLPLLNTAARVPVCGLVSGYNATGLPDGPDRLPLLMATILKKRIRMQGFIIGQDYGHRIAEFQQQMGRWVQEGKIKYREQLIDGLDQAPQALIGLLKGENFGKVVIRVAADD

SEQ ID NO: 220 - protein, 803 aa, Klebsiella pneumoniae
MTNHWVDIKNANVVVVMGGNAAEAHPVGFRWAMEAKNNNDATLIVVDPRFTRTASVADIYAPIRSGTDITFLSGVLLYLIENNKINAEYVKHYTNASLLVRDDFAFEEGLFSGYDAEKRQYDKSSWNYQFDENGYAKRDETLTHPRCVWNLLKQHVSRYTPEVVENICGTPKADFLKVCDVLASTSAADRTTTFLYALGWTQHTVGAQNIRTMAMIQLLLGNMGMAGGGVNALRGHSNIQGLTDLGLLSTSLPGYLTLPSDKQTDLQSYLSANTPKATLPEQVNYWSNYPKFFVSLMKSFYGEAAQKENDWGFEWLPKWDQAYDVIKYFNMMDNGNVTGYICQGFNPVASFPDKNKVVRSLSKLKYMVVIDPLVTETSTFWQNHGESNDVDPSAIQTEVFRLPSTCFAEEDGSIANSGRWLQWHWKGQDAPGEARNDGEILAGIYHRLRELYRTEGGKGAEPLLKMSWRYKQPDHPESEEVAKENNGYALADLYDQNGTLLAKKGQLLNSFALLRDDGSTASSCWIYTGSWTEQGNQMANRDNADPSGLGNTLGWAWAWPLNRRVLYNRASADINGKPWDAKRMLIQWNGNKWVGNDIPDFNTAPPGSNTGPFIMQQEGLGRLFALDKLAEGPFPEHYEPMETPLGTNPLHPKVVSSPVVRLYEEDAIRLGKKDKFPYVGTTYRLTEHFHTWTKHALLNSIAQPEQFVEISEGLAKSKGIANGDWVKVSSKRGFIRAVAVVTRRLRTLNVNGQQVETVGIPLHWGFEGVARKGYIANTLTPNVGDSNSQTPEYKAFLVNIEKA

SEQ ID NO: 221 - protein, 655 aa, Klebsiella pneumoniae
MLPGRYAVGFSSDSGDVPLMPLLRDEIRDHSAEEMLFIRRAAIAFLLVVVCFGVLIVNLYHLQVEQHDFYQTRSNQNDIKMLPIAPSRGLIFDRNGIPLVQNITLYRLQVIPSKIPDMAALLQQLTPIVDLTPDDIASFRDDMHHTSRYKAVTLKSDLSDVEVARFAVNEFRFPGVTVESYQQREYPYGAELAHVVGYVSKINDSDLQRLAKNGEEENYAADRNIGKQGIEGYYEKALHGTTGYQEVEVDNHGRVVRLLKEVPPVAGKNLYLTLDLHLQQYIESVLKGQRAAVVVVDPRDGGVLAMVSSPSYDPNPFVKGIGYQAYKSLLENPDRPLINRVTQGLYPPASTVKPYMALSALSAGVITPNTTFFGAPTWTLPGTQRRYRDWLKTGHGMLNVTKAIEESADTFFYQVAFEMGIDRIHEWLSKFGYGQSTGIDLNEEYAGVLPSREWKQRVHKKPWYQGDTISVGIGQGYWIATPIQMVKALTTLLNNGKVQDPHLLYSMKQGNHVERYQQPANLPQVGDPKSPYWGIVRNGMYGMANQPNGTGYKLFHTAPYQIAAKSGTSQVFSLKQNQTYNAKMIPVRLRDHIFYTLFAPYQHPKVAMALILENGGGDGVVAGPTARAILDHIFVPQQASSAAADVPQRDSADAQ

SEQ ID NO: 222 - protein, 372 aa, Klebsiella pneumoniae
MNICCANAKAIAGKNSSLNLTEMPAMNPASKKNILVLAALGAAALAAASYGAYWWHTGRFMQTTDDAYVGGDISAISSKVSGYIQQLAVQDNMAVKKGDLLIRIDDRDYRAALAKAAGEVAAQQAALADIQATRQLQQATITGSAASLLAATAATEKLANDNRRYNALAASSAISAQIRDNASADYRRAHAEQEKAKADKTVAERQLAVLDARQQQILAALAQAQANLEIARLNLSYTDIRAPFDGVIGNRRAWSGSFVSSGTQLLSLVPAHGLWIDANFKENQLAHMRAGQPVTIVADVLPNHTFKGHVASLAPATGSRFSILPAENATGNFTKIVQRVPVRIALEGDGAKLDVLRPGLSVIVTVNEKSPR

SEQ ID NO: 223 - protein, 180 aa, Klebsiella pneumoniae
MLLMQRITKLDNDLTCKGMLMKLWNKTLLASALCLTLFGCDDASKVDNKLDKAKDNAEQMKDAAADKAQAIKQDADKQIDTLKSQADAEADRLKDQASAIKAEADKKADAIAQQAKAQADAVKQNAKQESDRIVKEAGQIKDNAIGDANQLSAEAASKTKAIQDSIAKDKQNAAPPAAQQ

SEQ ID NO: 224 - protein, 168 aa, Klebsiella pneumoniae; identical to SEQ ID NO: 191

SEQ ID NO: 225 - protein, 853 aa, Klebsiella pneumoniae
MSTIDNLDAHTPMMQQYLKLKAQHPDILLFYRMGDFYELFYDDAKRASQLLDISLTKRGASAGEPIPMAGIPHHAVENYLAKLVNQGESVAICEQIGDPATTKGPVERKVVRIVTPGTISDEALLQERQDNLLAAIWQDSKGFGYATLDISSGRFRLSEPADRETMAAELQRTNPAELLYAEDFAESSLIEGRRGLRRRPLWEFEIDTARQQLNLQFGTRDLVGFGVENAPRGLCAAGCLLQYVKDTQRTSLPHIRSITMERQQDSIIMDAATRRNLEITQNLAGGTDNTLASVLDCTVTPMGSRMLKRWLHMPVRDTAVLVERQQTIGALQERYTELQPVLRQVGDLERILARLALRTARPRDLARMRHALQQLPLLRELLADVDSQPVQKLREKMGEFTELRELLERAVIDAPPVLVRDGGVIAPGYSEELDEWRALADGATDYLDKLEIRERERLGLDTLKVGYNAVHGYYIQISRGQSHLAPIHYVRRQTLKNAERYIIPELKEYEDKVLTSKGKALALEKQLYDELFDLLLPHLADLQTSASALAELDVLVNLAERAETLNYCCPTFSDKPGIRISEGRHPVVEQVLKEPFIANPLQLAPQRRMLIITGPNMGGKSTYMRQTALIALLAYIGSYVPAQKVEIGPIDRIFTRVGAADDLASGRSTFMVEMTETANILHNATEHSLVLMDEIGRGTSTYDGLSLAWACAENLANKIKALTLFATHYFELTQLPEKMEGVANVHLDALEHGDTIAFMHSVQDGAASKSYGLAVAALAGVPKEVIKRARQKLRELESISPNAAATQVDGTQMSLLAAPEETSPAVEALENLDPDSLTPRQALEWIYRLKSLV

SEQ ID NO: 226 - protein, 373 aa, Klebsiella pneumoniae
MRYVDEYRAPEQVMQLVAHLQQRARLLPHTAARPLRIMEVCGGHTHAIFKFGLDQLLPENIEFIHGPGCPVCVLPMGRIDACIEIASRPGVIFCTFGDAMRVPGKNGSLLQAKARGADVRIVYSPMDALRLAQQNPQREVVFFGLGFETTMPATALTLRQARERNVDNFYFFCQHITLLPTLRSLLDQPENGIDAFLAPGHVSMVIGTEAYGFIASDYHRPLVVAGFEPLDLLQGAVMLVEQTIAQRSDVENQYRRVVPDEGNPLAQAAMADVFRLDGDSEWRGLGVISDSGVQLTPAYQRFDAEAHFRPAPQRVCDDPRARCGEVLTGRCKPHQCPLFASTCNPQSAFGALMVSSEGACAAWYQYRSQENEV

SEQ ID NO: 227 - protein, 406 aa, Klebsiella pneumoniae
MTFSVEQVRADFPVLNREVNGQPLVYLDSAASAQKPEAVIGAEAEFYRHGYAAVHRGIHTLSAEATARMEAVRQQAATFLNAGSAEEVVFVRGTTEGINLVANSWGNANVGAGDNIIISEMEHHANIVPWQMLCARVGAELRVIPLNPDGTLQLDVVPGLFDPRTRLLAITEVSNVLGTENPLAALIALAHQHGAKVLVDGAQAVMHHPVDVQALGCDFYVFSAHKLYGPTGIGVLYARSELLQTMAPWEGGGSMIATVSLTEGTTWNQAPWRFEAGTPNTGGIIGLGAALTYVSQLGLTQIAEYEQTLMRYALDALRAVPDLILYGPAQRKGVIAFNLGQHHAYDVGSFLDNYGIAVRTGHHCAMPLMARYQVPAMCRASLAMYNTTEEVDRLVAGLQRIRKLLG

SEQ ID NO: 228 - protein, 337 aa, Klebsiella pneumoniae
MAPSRTLLAHSSTTGRMPEVLLVPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVMVDDMIDTGGTLCKAAEALKERGAKRVFAYATHPIFSGNAIQNIKNSVIDEFVVCDTIPLAPEIKALDKVRTLTLSGMLAEAIRRISNEESISAMFEH

SEQ ID NO: 229 - protein, 248 aa, Klebsiella pneumoniae
MSAMTLDLPRRFPWPTLLSVAIHGAVVAGLLYTSVHQVIEQPSPTQPIEITMVAPADLEPPPAAQPVVEPVVEPEPEPEPEVVPEPPKEAPVVIHKPEPKPKPKPKPKPKPEKKVEQPKREVKPAAEPRPASPFENNNTAPARTAPSTSTAAAKPTVTAPSGPRAISRVQPSYPPRAQALRIEGTVRVKFDVSPDGRIDNLQILSAQPANMFEREVKSAMRRWRYEQGRPGTGVTMTIKFRLNGVEIN

SEQ ID NO: 230 - protein, 221 aa, Klebsiella pneumoniae
MTQPEAVFFDCDGTLVDSEVICSRAYVHMFQEFGITLDLAEIFKRFKGVKLYEIIDTINAEYGVNLQKATLEPIYRAEVARLFDSELEVIPGAQALLDAVSVPMCVVSNGPVSKMQHSLGRTGLLRHFTDRLYSGYDIQRWKPDPALMFHAAEAMQVKAENCILVDDSSAGAQSGIAAGMEVFYFCADPHNQPIDHPKVTTFTDLAELPALWQARGWDITR

SEQ ID NO: 231 - protein, 380 aa, Klebsiella pneumoniae
VRRLRERGAEVRVAMTEAAKAFITPLSLQAVSGYPVSDSLLDPAAEAAMGHIELGKWADLVILAPATADLIARVAAGMANDLVSTICLATPSPVAVVPAMNQQMYRAQATQHNLQTLATRGLLLWGPDSGSQACGDVGPGRMLDPLTIVDMAAQHFASPVKDLQHLNLMITAGPTREPLDPVRYITNHSSGKMGFAIAAAAAQRGANVTLISGPVSLPTPPFVQRIDVTTALEMEAAVQAGAQQQHIFIGCAAVADYRAAVIAEDKIKKQGDELTIKMVKNPDIVAGVAALKSHRPYVVGFAAETNNVEEYARQKRARKNLDLICANDVSQPNQGFNSDSNALHLFWQDGEKRLPLERKELLGQLLLDEIVTRYDEKNRR

SEQ ID NO: 232 - protein, 454 aa, Klebsiella pneumoniae
MFRLSFMFIALLTAGCVSLDPHYDRPAAPVPATLPGAHGESTAVVGDWQKVVNDARLKKVVSIALNSNRDVQKALADIEAARAQYGETRASLFPTVDAELSHTRSKTVASGLSSASQADGAVSSFELDLFGKNQSLSRAARETWLASEFTAQNTRLTMIADLTTAWVTLATDNSNLALAQQTMDSAANSRNIVAHQMAVGTASAGDLSSAESVYQQARASVASYRTLVAQDKNAINLLAGETVPESLLPGTLESLGDNSIALVPAGVSSSVLLRRPDIQEAEHNLKSANADIGAARANFFPSISLTASAGVGSDSLSSLFSHGMQVWSFAPSISLPLFTGGSNLAQLRYAEAEKKGLIATYEKSIQSAFKDVADALARRETLSEELDAQRQYVAAEQTSLDIAMKSYQAGVGDYLSVLTAQRTLWSAKTTLLSLQQTDLNNRITLWQSLGGGAS

SEQ ID NO: 233 - protein, 513 aa, Klebsiella pneumoniae
MQLNSTEISELIKQRIAQFNVVSEAHNEGTIVSVSDGVIRIHGLAECMQGEMISLPGNRYAIALNLERDSVGAVVMGPYADLAEGMKVKCTGRILEVPVGRGLLGRVVNTLGAPIDGKGPLENDGFSAVEAIAPGVIERQSVDQPVQTGYKSVDAMIPIGRGQRELIIGDRQTGKTALAIDAIINQRDSGIKCVYVAIGQKASTISNVVRKLEEHGALANTIVVVATASESAALQYLAPYAGCAMGEYFRDRGEDALIVYDDLSKQAVAYRQISLLLRRPPGREAFPGDVFYLHSRLLERAARVNAEYVEAFTKGEVKGKTGSLTALPIIETQAGDVSAFVPTNVISITDGQIFLETNLFNAGIRPAVNPGISVSRVGGAAQTKIMKKLSGGIRTALAQYRELAAFSQFASDLDDATRKQLDHGQKVTELLKQKQYAPMSVAQQSLVLFAAERGYLADVELAKIGSFEAALLAYVDRDHAPLMQEINQSGGYNDEIEGKLKGILDSFKATQSW

SEQ ID NO: 234 - protein, 823 aa, Klebsiella pneumoniae
MEHAHPQVDANRVIAADRRLFGFQLPAFPFLIAHPVRGKAFRRGLQQQAQVTVAQSGPRRAKTHKVGGQLRRKIAGVKPPASVIGKTDFSRQQHRAEARHRHRLFSDNPRQQGFTGLGVLRLLPQAPRLQQRPGYPQIRVGRRVAVQQGPLLIVLFAPQPARQMLFQIAFRQVVLRPGQQFVEPCAIVGRQGEKQAIALPFGGGDFARIAGVNHPSLGADVRLFKLLPGGPLAGGAHLARRQQQRREHRATKYFHHGLLIIQAKTAAADDAQHAPQHPCQQHNADGGEDRQQYRVVREREPDALEPGQMTHVVNIPHPQTVDAGFADHRHRAKHRCPLTAVVEGVGQQFISARAVGQQGHHAALIVIRRLEANHRRHRPGRGNVGAGIGRAGLIVGINARQVIVAHRHFHPAFGRLDQQVDFGVVLERRRDRADQQQIRIFVLDLVAIVGHLQINRRQTGLRTDAPQRLQQRRHLALGRRLRHHHQRVGKVRHTAVREARIGEDAQVRQGDKVIILREVDGRIVADHHVVLHRLEGNTVVDGAAGHRVHILEVKAQLVDRPKTQRGDGDLRFAVQQPLQHRQAQDQFVHVLGAVKAERLQELVVEADIHPRAVLHRRHGVAVFQIHIDAVGPQQIEIRRQVKRHGDGIRHQAAGLQLLLIGFQLSKGDRTVGAHPVRRVVRLTRLQGFDAVHGDAAAAEQNIALSNPLRRQQQVVIIAAENHQQLDVGIVRVVDHFDGRRLDRRMIAQEVRTLVVGGEDNGVTIRQFIEIDRELLAAPAGLAAEPGGDYRRRLLLGDRWRARENHRQLQRAVIARIVERHREV

SEQ ID NO: 235 - protein, 397 aa, Klebsiella pneumoniae
VERFDAIVVGAGAAGMFCAAQAGQLGCRVLLLDNGKKPGRKILMSGGGRCNFTNMYVEPTAYLSQNPHFCKSALARYTQWDFIELVGKYGIAWHEKTLGQLFCDDSAEQIVNLLLAECEKGGVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 236 - protein, 225 aa, Klebsiella pneumoniae
MKQYLIAPSILSADFARLGEDTAKALAAGADVVHFDVMDNHYVPNLTIGPMVLKSLRNYGITAPIDVHLMVKPVDRIIPDFAEAGASIITFHPEASEHVDRSLQLIKEHGCKAGLVFNPATPLSYLDYVMDKLDVILLMSVNPGFGGQSFIPQTLDKLREVRQRIDASGYDIRLEVDGGVKASNIGEIAAAGADMFVAGSAIFGQPDYKQVIDQMRSELAKVSHG

SEQ ID NO: 237 - protein, 834 aa, Klebsiella pneumoniae
VENPSQPAQSGNSGENGAGGWDVMKRLTTLALLAGMLSAPALHSEEPGSGAAAPLSFPQLNDAADSEPGDEPPAASPEEGASPAAPATAGDAAATAPAPVMPDLPPPVSGTAAPEVIPVAPVWGGDLNLAQMGMPDGIILSGGQRQGGVSFTLPADQVVIHSQLSLAVRVSPEMASRNATLQLMLNGQPLGTLPLGADGEDVSHYQLDIPPALMVSSNNLSVKINDGDTLQCQRDIHDTSRVTVLPTSHFSWESQQLNISDDLSHFPRPFFDSMQMTPADIAVAYGAKPSADVFSAAALISSWLGIQADYRGIAFSALRDRLPERHGIVIGHPGEQVGGMMLPETDKPLLRIIANPANPAYKLLLIVGKNDTALRMAAWRLTRGNFAPQTATLDVEPQTIPVGKAYDAPRWIPTDRPVKLSELLRKDQSPTVSGVWHEPLRIAFRAAPDLYLWDGETIPLQVGYRFPSESWINEDKSLLSVTLNGTFLNNLPMNKQGPLEKVWRYLGGDARQERFTIPLAPYLIYGDNQLSMYFNVVPKDDVPCSVLLNNNIKSRITDDSWIDLSKTRHFSLLPNLSYFVGASFPFSRLADYSQTTLLLPADPSETQVATLLNLAARSGNATGTALANNRVVLGMPTGGGDLQSLRERDVLAVTALDQQAFNQSLLADSPYRPVDNVLSVREPDLWQKVQRRLTGDWTSASLDADRYFSSSSAWRGFISYRSPWNSTRLVVVALASNDDQLARLKTDLESPRINAGIRGDTAVITSDNGVRSFQVSTPFPSGQMPWYMMAVWYASQHSGFLAVLGLIATSIMGLALTAMFKRHARKRLGSGDNQ

SEQ ID NO: 238 - protein, 137 aa, Klebsiella pneumoniae
MRPWCTSKAKSKTAYRRCRLTGNCIVKKWPDRSPTVFTNVRPKESTMLINLGRLLMLCVWAFLLLNLFQPFPKPLNIFVNVALIFMILMHGLQLTLLKATQPKEAPPLSRFEQIRIFIFGVFELVAWQKKLKATLKK

SEQ ID NO: 239 - protein, 167 aa, Klebsiella pneumoniae
MAHIEKQAGELQEKLIAVNRVSKTVKGGRIFSFTALTVVGDGNGRVGFGYGKAREVPAAIQKAMEKARRNMINVALNHGTLQHPVKGTHTGSRVFMQPASEGTGIIAGGAMRAVLEVAGVRNVLAKAYGSTNPINVVRATIDGLENMKSPDMVAAKRGKSVEEILGK

SEQ ID NO: 240 - protein, 847 aa, Klebsiella pneumoniae
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 241 - protein, 1663 aa, Klebsiella pneumoniae
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVSNTGSQPLWLRLDSSGYPQSAPQPGGNVLGIERTIFDTQGQQKSLSSLRSGELVLVKLEVTAKRNVPDALVVDLLPAGLELENQNLANSSASLQENGDAVQNLLNQMQQADIQHIEFRDDRFVAAVAVNEGQPVTLVYLARAVTPGTYQVPQPQVESMYAPQWRATGAASGPLTVTP

SEQ ID NO: 242 - protein, 245 aa, Klebsiella pneumoniae; identical to SEQ ID NO: 195

SEQ ID NO: 243 - protein, 217 aa, Klebsiella pneumoniae
VINLNGNSSSSRQVTFITHPSIQSKAFASYLSETLMAPVVLQNINKPLAQRLAKDSVILFDIAVSNKKLNGVWRDIIRLQADNPRLLIINSAQKYELYEMAQWPALYGVFRHDDDESRLIEGVKAVLNGEQTAELSVMHPAMYAADHASTPVENSPLTERECEILNELRCGATNLDIARALFISENTVRTHLYNVFRKLSVKNRTQAVSWANEHLRH

SEQ ID NO: 244 - protein, 384 aa, Klebsiella pneumoniae
MAKHLFTSESVSEGHPDKIADQISDAVLDAILEQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPVTYAHRLVQRQAEVRKNGTLPWLRPDAKSQVTFQYDDGKIVGIDAVVLSTQHAEDIDQKSLQEAVMEEIIKPILPTEWLNASTKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYKETAAYGHFGREHFPWEKTDKAALLREAAGLK

SEQ ID NO: 245 - protein, 490 aa, Klebsiella pneumoniae
MPRKFCSGLAFAIATSEAPIPKPISKVTGASRPNRAAKSSGASLNSTPITGQMLSSACCCPFVRRPWRRTKLRIRRSGRPFSSNSGEMTSFFIKVWSACECVRKTGIIQSYSADARVYSHSPLCCNLPPCNRDPGAVALTFLATQFSAQVLDWYDKYGRKTLPWQIAKTPYKVWLSEVMLQQTQVTTVIPYFERFMARFPTVVDLANAPLDEVLHLWTGLGYYARARNLHKAAQQVATLHGGEFPRTFDEVAALPGVGRSTAGAILSLSLGQHYPILDGNVKRVLARCYAVSGWPGKKEVEKRLWDISEEVTPAEGVERFNQAMMDLGAMVCTRSKPKCELCPLSNGCVAYANHSWAEYPGKKPKQTLPERTGYFLLMQHGDEVFLSQRPPVGLWGGLFCFPQFADEAELREWLAQRQIKADNLTQLTAFRHTFSHFHLDIVPMWLTVHSSGACMDEGNALWYNLAQPPSVGLAAPVERLLQQLKAGAPV

SEQ ID NO: 246 - protein, 98 aa, Klebsiella pneumoniae
VTYWSPVSAWDVWGLAIRQRVSIAGRWTKQPAGTSSATLWNRASIFTIPPSPIRTAPANGTLAGRCGRWQNARRWCWPPSFCHEPPRRLPRGSAENRL

SEQ ID NO: 247 - protein, 703 aa, Klebsiella pneumoniae
MYMTCRLGYIVHTFFRRSPKRALVKSLRAWPSTVRTGVKMSSRKELANAIRALSMDAVQKAKSGHPGAPMGMADIAEVLWRDFLNHNPNNPAWADRDRFVLSNGHGSMLIYSLLHLTGYDLPIEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLVAFYDDNGISIDGHVEGWFTDDTAKRFEAYGWHVVRGVDGHDADAIKRAVEEARAVTDKPSLLMCKTIIGFGSPNKAGTHDSHGAPLGDAEIALTREALGWKHAPFDIPSDIYAQWDAKEAGQAKEAAWNEKFAAYAKAFPQEAAEFTRRMKGEMPSDFDAKANEFIAKLQANPAKIASRKASQNAIEAFGPLLPEFLGGSADLAPSNLTLWSGSKPINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAIAWKYGVERQDGPTALILSRQNLAQQERTAEQLANVARGGYVLKECTGSQPELIFIATGSEVELAVAAWDKLTAEGVKARVVSMPSTDAFDKQDAAYRESVLPKAVTARVAVEAGIADYWFKYVGLNGAIVGMTTFGESAPAEQLFEEFGFTVDNVVAKAKALL

SEQ ID NO: 248 - protein, 253 aa, Klebsiella pneumoniae
MPVFRTHSQADQTFMKNDVISPEFDENGRPLRRIRSFVRRQGRLTKGQQHALDNIWPVMGVEFNDAPLDFAALFGRDAPVTLEIGFGMGASLVAMAKAKPEQNFLGIEVHSPGVGACLASAEEEGVQNLRVMCHDAVEVLHTMIPDNSLNMVQLFFPDPWHKARHNKRRIVQPPFAELVKSKLKLGGVFHMATDWEAYAVHMLEVMSSLEGYRNQSASNDYVPRPESRPVTKFEQRGHRLGHGVWDLMFERVK

SEQ ID NO: 249 - protein, 480 aa, Klebsiella pneumoniae
VSQSVLVLGASGYIGQHLVRELSARGYPVLAAARHIDRLQKLALPGVTCRSVDLNQPQDLPALLTGIDTLYYLVHGMGEGGDFIAHERRVATYVRDALRQSSVRQVIFLSSLQAPAQEQSDHLRARQITGDLLRESGVPVTELRAGIIVGAGSAAFEVMRDMVYNLPVLTPPRWVRSRTTPVALENLLVDLVELLNHPSDAHRVFEAAGPEVLSYQQQFIRFMAVSGKHRPLIPIPLPTRWISVWFLNVITSVPPTIAKALIQGLKHDLIADDRALRALIPQTLIPFDQAVRRTLKEEEQLVNSSDWGYDAQAFARWRPEYGYYPKQAGCTVATQASRQALWQVVNQIGGEEGYFFGNLLWKTRGAMDLLVGHRLAKGRPQRAYLQTGDTVDSWKVIIVEEEKQLTLLFGMKAPGLGRLSFTINDKGDRRELDVRAWWHPHGMPGLIYWLLMIPAHLFIFRGMAQRIARLAEQISGRVEG

SEQ ID NO: 250 - protein, 381 aa, Klebsiella pneumoniae
MSLNMFWFLPTHGDGRYLGTEEGARPVDYGYLQQIAQTADRLGFTGVLIPTGRSCEDAWLVAASMIPVTQRLKFLVALRPSVVSPTVAARQAATLDRLSNGRALFNLVTGSDPAELAGDGVFLDHTERYEASAEFTHIWRKLMEGETVTFNGKHQRVRDAKLLFPPLQQPRPPLYFGGSSEVAQELAAEQVDLYLTWGEPPAQVAEKIAQVREKAARHGRQVRFGIRLHVIVRETNEEAWQAADSLISHLDDETIARAQAAFARTDSVGQQRMAALHNGRRDKLEISPNLWAGVGLARGGAGTALVGDAATVAERINEYAALGIDSFIFSGYPHLEEAYRVGELLFPLLDVAVPSIPQPQNLRLQGEAVANEFIPRKVAQS

SEQ ID NO: 251 - protein, 182 aa, Klebsiella pneumoniae
VAFAGRSNAGKSSALNTLTNQKNLARTSKTPGRTQLINLFEVAEGKRLVDLPGYGYAQVPEEMKIKWQRALGEYLEKRLCLKGLVVLMDIRHPLKDLDQQMIEWAVESDIQVLVLLTKADKLASGARKAQVNMVREAVLAFNGDVQVEPFSSLKKSGVDKLRQKLDSWFNEIPPQEAVEDAE

SEQ ID NO: 252 - protein, 328 aa, Klebsiella pneumoniae
MKTKTSLILTVAALALSGSALAEVKIALVAKSLGNGFFEAANVGAQQAAKELGDVKVIYTGPTTTTAEAQIDVLNGLIAQGVDAIAISANDPDAVVPVLKKAMQRGIKVVSWDSGVAPAGRQIHLNPSNNALIGETNVKLAADALQALNVEKGEVAVLSATPTSTNQNIWIEEMKKVLPQYPSVQLVTVAYGDDLSDKSYREAVGLLKSYPDLKVIVSPSSVGIVAAAQAVKDQGKIGKVYVTGLGLPSEMAGAIKSGASKSFAIWNPIDLGYAATYLADDLVKGTATKTEASMGKLGKVNLDAEGNGAMAKPFVYDASNIDKFSKIF

SEQ ID NO: 253 - protein, 146 aa, Klebsiella pneumoniae
MLGWVITCHDELAQEMLDRLEQKFGPLAQCRAVNYWRNLSSNMLSRMMCDALHATDSGDGVIFLTDKTGAAPYRAAALMSHKHTHCEVISGVSYPLLERMYLLRGTLSSVAFRQAIVSAGGPMVSSLWHQQQKNPPFRLRHDAWGN

SEQ ID NO: 254 - protein, 221 aa, Klebsiella pneumoniae
VPVQCKGFLFDLDGTLVDSLPVVERSWCKWGDRFAIDHDEILSFIHGKQAITSIRHFMPGRSEEDIQAEFRYLEQIEATDIEGIVALPGALALLNTLNEAGIPWAIVTSGSIPVAHARHRAAGLPMPEVFVTAEQVKHGKPAPDAYLLGAERLGLPAGECAVVEDAPAGLLSGLAAGCRTIAVNVPADAPRLDEADLVLSSLEDLVVERQTDGVVNVRLKA

SEQ ID NO: 255 - protein, 229 aa, Klebsiella pneumoniae
VASKFQNRLVGTIVLVALGVIILPGLLDGQKKHYQDEFAAIPLVPKPGDRDEPDMLPAATQALPSQPPEGAAEEVRAGDAAAPSLDPSRIPVNSNSFDDVQEPVVAAKPQPKPQPKPQPQQQASTPTPPPAKPQQQQPPQQQAALPAPTGKAYVVQLGALKNADKVNEIVGKLRASGFKVYTSPSTPVQGKITRILVGPDASKDKLKGQLGDLQQISGLSGVVMGFTPN

SEQ ID NO: 256 - protein, 257 aa, Klebsiella pneumoniae
VAILFYQGTSSMRKIALFIAMLLLPCVSFAGLLSSNSPTTPVSKEYKQQLMGSPVYIEIFKEERMLDLYVKMGETYQLLDSYRICNYSGGLGPKQRQGDFKSPEGFYNVTRSQLKPDSRFYKAINIGFPNAYDRAHGYEGKYLMIHGDCVSVGCYAMTDSGIDEIFQFVTGALVFGQPSVQVSIYPFRMTNANMERHKYSYYADFWKQLKPGYDYFQQTHKPPVVSVTDGRYVVSKPLSHEVVQPQLASNYTLPETK

SEQ ID NO: 257 - protein, 455 aa, Klebsiella pneumoniae
MKARAILLASVLLVGCQASKHDGTVEQRAQSLSAAGQGEAGKFTSQARWLDDGTFYAQDQDLWTSIGDELKMGIPDNPRIREQKQKYLRNKSYLHDVTLRAEPYMYWIAGQVKKRNMPMELVLLPIVESAFDPHATSGANAAGIWQIIPSTGRNYGLKQTRSYDARRDVVASTTAALDMMQRLNKMFDGDWLLTVAAYNSGEGRVMKAVKANRSRGKPTDFWSLSLPHETKIYVPKMLALSDILKNSKRYGVKLPTADESRALARVRLDSPVDISQLADMAGMPVSKLKTFNAGVKGSTLGASGPKYVMVPQKHAAQLRESLASGDIAAVQPTQLADNTPLTSRSYKVRSGDTISGIASRLGVTTRDLQQWNNLRGSGLKVGQNLVIGAGSSAQRLANNSDSITYRVRKGDSLSSIAKRHGVNIRDVMRWNSDTDNLRPGDQLTLFVKNNDRPES

SEQ ID NO: 258 - protein, 402 aa, Klebsiella pneumoniae
FSDTQTHLRFGAHDFTAQRVGVYIDDFDIDKLTDEVRGTFEVDHPVILRTSGKLHDVLTRGAFHQDALYRAEHATAPGHRLLVNAFLQDIQTLFFVRLRHVVDHIGRRGARASGEDKAVAHIEIDVGDELHGLFEIFRGFAGEADDKVGAYLNIRARFTQLANNRFILQRGMGASHQVQHTVGATLHRQVQEAHQLRRIAINVDDIVGKFDRVAGGEANAVDAVDGGDQAQQVGKAAGGAVVILTAPGVNVLPQQIDLTHTLRRQLGDFKQDIVARTANFFSAGIRHHAVGAVFIATFHNRDKGGRPFGARLWQAIEFFNFREADINYRTAVAAHGVNHLRQAVQGLRPENNIDIVRALANMVAFLGSHAAADANNQVRVLLFQQLPAAKLMENFFLGLLTN

SEQ ID NO: 259 - protein, 512 aa, Klebsiella pneumoniae
MVFASLLERQRVRLLLALLFGASGTLAFSPYDFWPAAIVSLIGLQALTLNRRPLQSAGIGYFWGLGLFGTGINWVYVSIAQFGGMPGPVNVFLVVLLAAYLSLYTGLFAGLLARLWPKTNWIRMAIAAPVVWQITEFLRGWVLTGFPWLQFGYSQIDGPLKGLAPVMGVEAINFLLMVVSGLLALALVQRNWKPLAIAALLFALPFPLRYIQWYQLLPARATQVSLVQGDIPQAMKWDEKQLVNTLKTYLALTQPHIGHSQLIIWPESAIPDLEINQQQFLSMMDDLLRAKDSSLITGIVDARLNKQNRYDTYNTIITLGKDNPYRYDSTNRYNKNHLVPFGEFVPLESILRPLAPFFDLPMSSFSRGPYVQPQLMAHNLKLTAAICYEIILGEQVRDNFRPDTDFLLTISNDAWFGKSIGPWQHFQMARMRALELARPLLRSTNNGITAVIGPRGEIQKMIPQFTREVLTTTVTPASGLTPYARTGNWPLWALTALFGFAALLMSLRQRRR

SEQ ID NO: 260 - protein, 310 aa, Klebsiella pneumoniae
MLKFIRAGMYTSVQDGGREGQRQWGISRCGALDKPAMTIANLLVGNAPEAAALEITLGQVDVQFTRHCWFALTGAACEATLDGAPVWLGWRMEAKAGQRLVLKNPQHGIRSYLAVAGGIDVPEVLGSRSTDLKVGIGGIEGRRLQDGDQVKIGKSSRRFSSSRGVKQLPIGNIIRALPGPEYHEFDSVSQESFWRSPWKLSPQSNRMAYRLQGQPLRRTTDREMLSHGLLPGVVQVPHNGQPIVLMNDAQTTGGYPRIACIIEADIYQLAQIPLGQPIHFVPCSLEEALKARADQQRYLEQLAWRLSDEN

SEQ ID NO: 261 - protein, 760 aa, Klebsiella pneumoniae
MRAAFPESSSLPFRQRLLYLPVYVATEVPMPWILLLLAALFTAPLSAATLPGVPTANTDKNSASEPDVEQKRAAYAALADVLANDSARQELIDQLRKAAATPPPDSTPTLTPPAVKEETTVLENVTQISREYGEQLSSRFSQLWRNITGSPHKPFNPQTFTSAAWHFLLLAGLVFAFWWLVRLAALPLYRKMGEWGRHKNRDRGNWLQLPLTIAGAFIIDLLLLALTLFVGQLLSDRLNGNNPTIAFQQSLFLNAFALIEFFKAILRLIFCPRIPALRPFNLSDEAASYWSLRLSALSSLIGYGLIVAVPIISNQVNVQVGALANVVIMLCITLWALYLIFHNKAVITQGLIHLADHSLAFFSLFIRAFALVWHWLACAYFVVLFFFSLFDPGNSLKFMMGATLQSLAIIGGAALVSGILSRWIAKTITLSPATQRNYPELQKRLNGWISASLKAARILTVCVAIMLLLSAWGLFDFREWLHNDAGQKTVDVLIRIALILFFSAIGWTVLASLIENRLASDIHGRPLPSARARTLLTLFRNALAVVISTITVMILLSEIGVNIAPLLAGAGALGLAISFGAQTLVKDIITGIFIQFENGMNTGDLVTIGPLTGTVERMSIRSVGVRQDTGAYHIIPWSSITTFANFVRGIGSVVANYDVDRHEDLDKASQALKAAVDDLLAQEEIRGLIIGEPSFAGLVGLSNTAFTLRVSFTTLPLKQWTVRFALDTQVKKHFDRAGVRAPVQTWQQLPMPGADSPAAE

SEQ ID NO: 262 - protein, 769 aa, Klebsiella pneumoniae
MKKQHNYTVMHWGTWQVESREGEIVAVKPVPWDKNPSRIGQSLPDAVTSQTRIRRPAVRAGYLQHGPASREGRGKEPFVEVSWEVALDLLARELRSVKARCGNEAIYGGSYGWASAGRFHHAQSQLHRFLKGFGGYTASTNTYSSAAGERILPHILGPLSPLHRQHTHFSELARECQLFVAIGGLPLRNAQVNGGGANDHMLQYWLDKMQANGTRFINISPVRNDLSAVPDAEWLAIRPGTDIALLLALSYVLIAESLYDQAFVASHTVGFAPYRAYLLGEHDGVAKTPAWAAAITGLDAQRIADLAREMARHRTMVNISWSIQRARQGEQAYWATVALTALLGQLGTPGGGLGFGYACTNLAGAVRKAFSGPRLPAGENAVDSVIPVARLSDMLLHPGETYEFDGQQRRYPDIRLVYWAGGNAFHHHQDINRLCEAWRRPETVVVHEQYWTAQAKFSDIVLPATTSLEREDIGSGGHDGFMIAMSAQIPPVGEARDDYAIFCDLAGRLGFGEAFSEGRDAGQWLRHLYEESRPRAQEEGIALPSFDDFWQQGVLEYSAPERPQIFLADFRADPQRYPLSTPSGKIELFSATVAGFGYRECPGHPWWDEQEAARQRQEAARWPLHLLSSQPRARLHSQYDHGSVSRATKVQGREPLWMHPSDAQARDIREGSVVKVYNDRGAILAGVHLSEQILPGVVQMSTGAWYDPLDPKEERSLDKHGNPNVLTEDRGSSRLGQGCSAQSCWVEIAPWREELPPITAFDPPKFIEV

SEQ ID NO: 263 - protein, 248 aa, Klebsiella pneumoniae
MKSVFKVSLAALTLAFAVSSHAANKTLVVATDTAFVPFEFKQGDKYVGFDVDLWAAIAKELKLDYTLKPMDFSGIIPALQTKNIDLALAGITITDERKKAIDFSDGYYKSGLLVMVNANNNDIKDVKDLNGKVVAVKSGTGSVDYAKANIKTKDLRQFPNIDNAYMELGTGRADAVLHDTPNILYFIKTAGNGKFKAVGESLEAQNYGIAFPKGSDELREKVNGALKTLRDNGTYNEIYKKWFGTEPK

SEQ ID NO: 264 - protein, 421 aa, Klebsiella pneumoniae
MAALPTHETLPADHKAAIRQMKQALRAQIGDVQAVFDKLSARISERLQEIETLKAAGQEVWPTVPFRDIAEGTVSDEQRAAIKRRGCAVIKGHFPREQALAWDTAMLEYLDRNHFDDVYKGPGDSFFGSLEASRPEIYPIYWSPSQMQARQSDEMAAVQSFLNRLWRFEQNGKRWFDPDVSVIYPDRIRRRPPGTTSKGLGAHTDSGALERWLLPAYQQVFANVFNGNIDAYDPWDAAHRTEVEEYTVDNTTKCSVFRTFQGWTALSDMIPGQGLLHVVPIPEAMAYVLLRPLLDDVPEDELCGVAPGRVLPISEQWHPLLIKALSSIPALNAGDSVWWHCDIIHSVAPVENQQGWGNVMYIPAAPMCEKNLAYAQKVKIALEKGASPGDFPREDYEASWQGRFTLEDLNIHGKRALGMPV

SEQ ID NO: 265 - protein, 323 aa, Klebsiella pneumoniae
MADFPPVASLRSFEAVARLGSVTQAAHEMSVTHSAVSQHIKQLEALVGVTLFIRHGRGVRITEEGRLYALQIREALQHIADATRMVQIKPRTLEVTLATIPSFGCHWLLPRLARFQARHPQIAVRLLTSLAVVNLQQEGIDLAIRMGQGDWEGMESRHLFADEQLVVAAPGYRGGNLPTTPQAIAASDIIFSMESWHAWCSQAGLEKPIVPAGLRLNDSNLVLEAVRLGAGVALERRSLVAGAIARGELVQLTAVTVPYPWHYWLTVSPQAENRPEVARFIAWLEEEIALWRQQISAYLRRRRQAVRAACSWERRQKSCPAGY

SEQ ID NO: 266 - protein, 221 aa, Klebsiella pneumoniae
MRNQPLGNLAAGAVDHVNHPIRDTHRFCQLRHAQQRQRRIFARLEDDGAAADQGRRQLPDGNHDGEVPRHDANHHPQRLAAGKGGIFLPGHRWQRDIQRFTGDFPRPAGEVAQERHRLVQLEHPRQRDSFAGTETFQLRQRFAMLCQRVRQLQQQRAARQRRHLAPLTKRLAGALHSAIRLVTIRRGDLGNRPPGRRVDHRERRAAARLTLTGNKLPVRLA

SEQ ID NO: 267 - protein, 335 aa, Klebsiella pneumoniae
MRFIWLYTELKNAPTLKTYSAAVDWNVPGHYFAETFSRSGMNPSGQSIRGEIMKKSLASMCLSAVLTVAFSYHAVAADLPEIEKSGTLKVATEDDYAPFNFMNNGQADGFNKDMLEELRKYAKFHVDQSILPWTGLLAAVSTGQYDMALTGAVITDERLKVFDFTPPWASAQHYFVKRAGDTSLNTIADLSGKKVGVQAGSALLARLPELKAMLEKTGGKLGPVVEYPSYPEAYADLANKRLDYVINVVISVNDLAKAKPKVFAKGLAVSGPGYMAWPIPKNSPQLLAYMTRFMNHMKETGKLAELQKKWFGETYDNLPTEAITSPEQFHKLAGL

SEQ ID NO: 268 - protein, 633 aa, Klebsiella pneumoniae
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 269 - protein, 742 aa, Klebsiella pneumoniae
MNNRIKSLALLVNLGIYGVAFPLSAAETATDDKNSAAEETMVVTAAEQNLQAPGVSTITADEIRKRPPARDVSEIIRTMPGVNLTGNSTSGQRGNNRQIDIRGMGPENTLILIDGKPVTSRNSVRLGWRGERDTRGDTSWVPPEMIERIEVIRGPAAARYGNGAAGGVVNIITKKTGDEWHGSWNTYMNAPEHKDEGSTKRTNFSLSGPLGGDFSFRLFGNLDKTQADAWDINQGHQSERTGIYADTLPAGREGVKNKNIDGLVRWEFAPMQSLEFEAGYSRQGNLYAGDTQNTNSNDLVKENYGKETNRLYRNTYSVTWNGAWDNGVTTSNWAQYERTRNSRKGEGLAGGTEGIFNSNQFTDIDLADVMLHSEVSIPFDYLVNQNLTLGSEWNQQRMKDNASNTQALSGGEIPGYDSTGRSPYSQAEIFSLFAENNMELTDTTMLTPALRFDHHSIVGNNWSPSLNLSQGLWDDFTLKMGIARAYKAPSLYQTNPNYILYSKGQGCYASKDGCYLQGNDDLKAETSINKEIGLEFKRDGWLAGVTWFRNDYRNKIEAGYAPVYQNNKGTDLYQWENVPKAVVEGLEGTLNVPVSETVNWTNNITYMLQSKNKETGDRLSIIPEYTLNSTLSWQVRDDVSLQSTFTWYGKQEPKKYNYKGQPVTGSEKNEVSPYSILGLSATWDVTKYVSLTGGVDNVFDKRHWRAGNAQTTGGATGTMYGAGAETYNESGRTWYLSVNTHF

SEQ ID NO: 270 - protein, 203 aa, Klebsiella pneumoniae
TQVAKRVPQFTAVILHHLQRTTDVDCAGFIRIVIGRERTQAVLYCPLTLEKGQHLPPGADKRFGKIFSVLALADNGSQVGFHRLGATAFALGARLVGIVQPHGAAGDGRGAAELAGFLQHQHRQPFTAGGDRGGKTGRAAADDDHIPALHAAAPCACGMAPINWPISLICASAISGPVCTLQPRAAAKVSNGVITGAVTTSAT

SEQ ID NO: 271 - protein, 313 aa, Klebsiella pneumoniae
MRGVIQQTLCQQMTHFSRPAVNSTAALVLRSLSDEPETRAQTVILYVFIRSPMTSSLSRHPAFLSLQGGINFRDLGGQLAADGRRVRSGKLLRSGALNRLTAEDLNHLDTLPLSRVLDYRDPGEVARTPDKLSPLTHYLNAPANPPVSEVNAKVTELNAATLNALNGEQFMLQLYRQLPFNNPAYRQLAAWLTTPFEGALLQHCAVGKDRTGVGCALTLFAVGCDSETVMEEYLLTHGMLTQVEAWMLELLGNDLTAQGRQSLADILTVKESYLAAALSAIHQRYGTVDAWLAAEYQLTAPVRAALQARLLEE

SEQ ID NO: 272 - protein, 473 aa, Klebsiella pneumoniae
MISARWRCSGWVPVWVPRYSVLPLPPSSPGAMPSNGRPRSPHNRLTNKEEDMMPARHQGLLRLFIACALPLLALQSAAAADWQLEKVVELSRHGIRPPTAGNREAIEAATGRPWTEWTTHDGELTGHGYAAVVNKGRAEGQHYRQLGLLQAGCPTAESIYVRASPLQRTRATAQALVDGAFPGCGVAIHYVSGDADPLFQTDKFAATQTDPARQLAAVKEKAGDLAQRRQALAPTIQLLKQAVCQADKSCPIFDTPWQVEQSKSGKTTISGLSVMANMVETLRLGWSENLPLSQLAWGKITQARQITALLPLLTENYDLSNDVLYTAQKRGSVLLNAMLDGVKPEANPNVRWLLLVAHDTNIAMVRTLMNFSWQLPGYSRGNIPPGSSLVLERWRNAKSGERYLRVYFQAQGLDDLRRLQTPDAQHPMLRQEWHQPGCRQTDVGTLCPFQAAITALGQRIDRSSAPAVAMVLP

SEQ ID NO: 273 - protein, 1030 aa, Klebsiella pneumoniae
MLTFFIRRPRFAMVIALLLTFVGAVSLKLIPVEQYPAITPPVVNVSASWPGASASDVAEAIAAPLETQLNGVDHMLYMESTSSDEGTYRLSITFAAGTDADLAAIDVQNRVAQALAQLPAEVQQNGVQVRKRASNLLMGVSLYSPLGTLSPLFVSNYASTQVREALARLPGVGEVQMFGARDYSMRIWLRPDRMNALNITTDDVAQALREQNVQGAAGQVGTPPVFNGQQQTLTINGLGRLNEAASFGEIIIRRGAQGQLVRLADVATIELGARSYSSGAQLNGKASAYLGIYPTPTANALQVASAVRAELNRLHTRFPADLTWEVKFDTTRFVAATIKEIGVSLALTLLAVVVVVSLFLQSWRATLIVVLAIPVSLIGTFAVLYLLGYSANTLSLFAIILALTMVVDDAIVVVENVETKMAEGLDRLQATAQALRQIAGPVIATTLVLLAVFVPVALLPGIVGELYRQFAVTLSTAVALSSLVALTLTPALCALLLRPRPARPAAVWRAFNRLLDGTRDGYGRLVGWMNRRPWLALAATVAAGALVAFSFTSMPKGFLPQEDQGYLFASVQLPEAASLERTEAVMAQARKLLMANPAVEDVIQVSGFNILNGTSASNGGFISVMLKDWHQRPPLDAVMADIQRQLLSLPEATIMTFAPPTLPGLGNASGFDLRILAQAGQSSAELEQVTREILQLANQYPQLSRVFTTWSSNVPQLTLTVHRDRAALLDVPVAQIFSSLQTAFGGTRAGDFSRNNRVYHVVMQNEMQWRERAEQISELYVRSRDGERVRLSNLVTITPTVGAPFIQQYNQFPSVSVSGSAAEGVSSRTAMAAMEQILQAHLPPGYDYAWSGISWQEQQTGNQAVWIVLAAVAMAWLFLVAQYESWTLPASVMLSVLFAIGGALLWLWTAGYANDVYVQIGLVLLIALAAKNAILIVEFARSRREEGLSIVDAAREGATRRFRAVMMTAVSFIIGIMPMMLATGAGAQSRRIIGTTVFSGMLVATMVGILFIPSLYVLFQRMREWAHRRG

SEQ ID NO: 274 - protein, 311 aa, Klebsiella pneumoniae
VRRAAAGAGRLRRPTAVYAVAAAGWRVNRQPRRYLPYCIVDSGVPQKMSAVPSRLRGEQLTLAYGNKTIAESLNVTIPDGHFTAIIGPNGCGKSTLLRTLSRLMTPASGHVWLDGAQIQQYASKEVARRIGLLAQNATTPGDITVQELVARGRYPHQPLFTRWRKEDEEAVNKAMRATGISDLALQSVDTLSGGQRQRAWIAMVLAQETAIMLLDEPTTWLDISHQIDLLELLSELNREKGYTLAAVLHDLNQACRYATHLIALRDGRIVAEGAPKEIVTADLIERIYGLRCTIIEDPVAHTPLVVPLGRR

SEQ ID NO: 275 - protein, 818 aa, Klebsiella pneumoniae
VWNTSPYTGLHINDDAVECGVVGYLADFKLRESSMNPERSERIEIPVLPLRDVVVYPHMVIPLFVGREKSIRCLEAAMDHDKKIMLVAQKEASTDEPGVNDLFTVGTVASILQMLKLPDGTVKVLVEGLQRARISALSDNGEHFSAKAEYLDSPAIDEREQEVLVRTAISQFEGYIKLNKKIPPEVLTSLNSIDDPARLADTIAAHMPLKLADKQSVLEMSDVNERLEYLMAMMESEIDLLQVEKRIRNRVKKQMEKSQREYYLNEQMKAIQKELGEMDDAPDENEALKRKIDAAKMPKEAKEKTEAELQKLKMMSPMSAEATVVRGYIDWMVQVPWNARSKVKKDLRQAQEILDTDHYGLERVKDRILEYLAVQSRVNKIKGPILCLVGPPGVGKTSLGQSIAKATGRKYVRMALGGVRDEAEIRGHRRTYIGSMPGKLIQKMAKVGVKNPLFLLDEIDKMSSDMRGDPASALLEVLDPEQNVAFNDHYLEVDYDLSDVMFVATSNSMNIPAPLLDRMEVIRLSGYTEDEKLNIAKRHLLPKQIERNALKKGELTVDDSAIIGIIRYYTREAGVRSLEREISKLCRKAVKQLLLDKSLKHIEINGENLHDYLGVQRFDYGRADSENRVGQVTGLAWTEVGGDLLTIETACVPGKGKLTYTGSLGEVMQESIQAALTVVRSRADKLGINADFYEKRDIHVHVPEGATPKDGPSAGIAMCTALVSCLTGNPVRADVAMTGEITLRGQVLPIGGLKEKLLAAHRGGIKTVLIPDENKRDLEEIPDNVIADLDIHPVKRIEEVLTLALQNEPFGMQVVTAK

SEQ ID NO: 276 - protein, 310 aa, Klebsiella pneumoniae
MQLQKLVNMFGGDLMRRYGEKVHKLTLHGGFSCPNRDGTLGRGGCTFCNVASFADEAQQHRSIAEQLAHQAQLVNRAKRYLAYFQAYTSTFAEVQVLRSMYRQAVSAANIVGLCVGTRPDCVPQAVLDLLSEYHQQGYEVWLELGLQTAHDKTLHRINRGHDFACYQRTARLARERGLKVCTHLIVGLPGESQGHCLQTLEQVVATGVDGIKLHPLHIVKGSIMAKAWQAGRLDGIELEAYTVTAGEMIRHTPPEVIYHRISASARRPTLLAPLWCENRWTGMVELDRYLNQQGAQGSALGRSWVAPQAE

SEQ ID NO: 277 - protein, 307 aa, Klebsiella pneumoniae
MNKIIENDFSRIDLNLLTVLMVLYREGSVTRTAEVLHLGQPAISGALKRLREMFDDPLFVRSARGMLPTPRAQALMTDLQPLMENLHSAMFGAGEFVPARAQQLFRIGLSDWSEHWLMPPLLPGLMQEAPGVSLQSIAADPFQVRQLLEEERIDVAVSVNKQSRGEVVSEPVMTMGVTTLWSPQQIPCRGPLSVSDFVAWEHVMVAYRETGHGEIDRQLASQGLARRVRFATQNFSTFPLLLTTLPLFATVPQGLAQRWQAQYALRADAPPVAYPEFTLCILRHKRRAQDPALNWLVTKLKQAMRGQ

SEQ ID NO: 278 - protein, 810 aa, Klebsiella pneumoniae
MLIDRDGIRLMGERKGQQATSQARQLRVEAFRRALPVTQKVPQHRLGAVQRIQQPEQRDIGYGKISHPFIAFATHGHQARQTSPELDEQLFKLPRQPAAALDLQQRREKRLVDKPGPLRVPLQANKRTGQVIAVVLVGEAEDQLRLYDGNLPGIIPKLVTDIAPALPEAHRPFGHLLRLQTVAAIRLHQGQRQHDHRLAGRAVQRQRGRQRIGIVRINHRAILEPDLQPVSLQAAQFEHLWFEGRLNHSPGVVKTHPGNHFRSPGCIRSLLLKMLRRHHNAPAPQRTFRFHHRPNLRLRLWHLANQRQIDVHPLDLEVRHRVQLHAEEARVILDIFHHHAGIAQRMGGLQLVAGVGHFGHQAPHPGVQLQLQQTPVLGGADIFALDHLQVVRDARQQEDVRQTRVDTAVGGGVGGIVQRRFLRGVGREEAGVIAIFVVRQRDKAQAGELKLPRFRDHHLGRDLHLVAGAQIVQMDRQIFHRAARLRTANLHAPAVVNKALHHIRCEGERRAGPEIFFVIRALHLLDIVEAAHRHGVRTVRQTTQHARHHQADVAGIVSFAKRLPADIFRTIEVVADILNGSHLFHGLFQEEGRADGADKRHMGGRRDAGDIAQQRHILRAGVELIGRDHRADRLAAGSVILRGIGVPVQAALDKLRRVLKVLAQIVFGDVEDLRFDVLPIVGVVHQLFEAAPQGFDLLKLLMVHHRVQLTAYLEIQLGDMVVDQRFVELFHPLAGLTDAFHKHLHRRGETLRRRRLGERGIVQKVVDIPEARRRGEINFFKQRGVNALARAVFLQRGLPLNRGVFCGNRH

SEQ ID NO: 279 - protein, 559 aa, Klebsiella pneumoniae
MDKPLRLKLKKCYHLARPAHVVNACFIAVLFFSTLLIWREINVLEEAYVANQRNNLANVAHEMDGLLQFNIDRMMFFRHGMQAALEQPLDIDVLRKASQRYLSQRHQQAWRVALPNRRTLPVFGISGSVAGDNPILLVDDPLAADELMATLELGYLLNLTQHDRDFAERMQYISRSGFFTSTLPLRDESQVITHYSQALGAPWFTRQTQRNNPGRGVIWQTFPDDDPQLEEQVVTASIPLDFAGYWRGVLAMDFSVSEIKAFLVSAMQGGQEGEYQLYDSHLNLLASSAPGNVLTLLSPREQELLSRAFVHDNQGGLRLLTRYISWAKLRNFDGVLLRIHTLREGVRGNFGTITIALTLMWVLFTLMLLLSWLVIRRMVRNMSVLQTSLEWQAWHDALTRLLNRGALFEQAMAVASDCQRSGRPLAVIQLDLDHFKHINDRYGHQAGDRVLSMVASTLSSAVRQGDLLGRVGGEEFCIVMPNTTLQEAAAVAERLRQRIQGREVFLHNNVTLRVSASLGVSASEERGEYQFEALQSVADGRLYLAKQNGRNQVCFRSAA

SEQ ID NO: 280 - protein, 311 aa, Klebsiella pneumoniae
MPRAVSLVDPSGLGHIAAEVALQLSTVQTQVGRFAHADVLPRRSFFKGELPGPQMRLGVGVEVKTLRLDLIDGVRRRGFNPVHLLRQQRRGTGVGLRQGDQHHFIHPGNAIFVPVVGVFIEDQLLTRHQLLQFERAATHRVGGEGGPRLFAARGAISHAGRHRVILLLPRRRRDDKQVGDVVRQQRIRFRGGQRHGVVVNFLCAGEGRHARQGVADLTRGVLRRRFIQYLIHVPDDGVGVHLRPIMKLHPRTQGENPAAGILRIDVPLGRQPRHQTAGLFTLRQIPLHQRVVQRDAGKAVALIALIRLAKG

SEQ ID NO: 281 - protein, 429 aa, Klebsiella pneumoniae
MMITLRKLPLAVAVAAGVMSAQALAVDFHGYARSGIGWTGSGGEQQCFKATGAQSKYRLGNECETYAELKLGQELWKEGDKSFYFDTNVAYSVNQEDDWESTSPAFREANIQGKNLIDWLPGSTLWAGKRFYQRHDVHMIDFYYWDISGPGAGLENVDLGFGKLSLAATRNSESGGSYTFSSDDTKKYAAKTANDVFDIRLAGLETNPGGVLELGVDYGRANPQDDYRLEDGASKDGWMWTGEHTQSIWGGFNKFVVQYATDAMTSWNSGHSQGTSIDNNGSMIRVLDHGAMDFNDDWGLMYVAMYQDVDLDSKNGSTWYTVGVRPMYKWTPIMSTQLEIGYDNVKSQRTSENNNQYKITLAQQWQAGNSVWSRPAIRIFATYAKWDENWGYSNTSGLQTKDSSGSGAFTSSRGDDSEVTFGAQMEVWW

SEQ ID NO: 282 - protein, 384 aa, Klebsiella pneumoniae
MGYKRVPEPPARTIPFIFTSLLVIQTKALTGIGAVQHALPPGLIVQVPVHGFLNPALERLLRHPAQIALNFRGINGITQVVSRTVGDKSDQVSKVGDVARLLRHHFVENGADGAHHIDIFTLVMTADIVGLAALAFGRHFVQRTGMVLNIQPVTDLLPVAIYRQRFTRQGVENGQRDQFLREVIRTIVVGAVGHHHRQAVGAVPGANQMVAARFGGRVRAARSVRGFFGEQVIGAVQVAVHLIGGDVVEAEGLLLHVPKSGPVVTGRLQHSKSADHVGLDEGCRTINGTVHMAFCRQVHHDIRAELAELGRHGSSIGDISLGKRVAFAPGHRRQGFEVAGVGQAVHHADFIPGIFNDMTNHGRADKACTAGDKNLHTFSRFSMT

SEQ ID NO: 283 - protein, 474 aa, Klebsiella pneumoniae
MPDISTPNLDYNDMVEAWDINDALMGGTLEMRRQGKKYLPKWPNEDPESYKERLASATLLPAYEEAIKQNIGRVFAEPTVLSEDSPEQIRELSPDIDMEGNRLDVWAQQFFNIGFQYGLVHALVDFPKIDREAVKTKADEKAAGSRPYATMLNPRQVIGWKSKVVKGKVVLTDLRIREVIIVDGDDYGQTKVEQIRHIMPGKVEIYRRNKGDNGESQWQIHDEWETSRDDIPLVTLYTKRTGFMRGSPPLLNLALLNIKHWQSQSEQDNILHVARVPLLVAYGLADGETLTIGSSSATRFDDRQRQGLEYVEHTGAAIEAGKISLEDLENQMRQAGAKLLRAENTSTKSLDQTHEERMQENSPLYTMASSLEDALDNILQIMAEWLGEKEGGNVDVRTELDVSAQTFDAAAATAVQSLRQGGDIRQVDAVRVLQALKFIDPDAKPEEVIDELRNQQVTLAGGLSNPGGANGNGE

SEQ ID NO: 284 - protein, 675 aa, Klebsiella pneumoniae
MNEFTGSAASQADFIWKNAEDLWGDFKHTDFGKIILPFTLLRRLECALEPTREAVREAHDAFKDADVELDTILRSTAEYPFYNTSEYSLGTLGSTKTRRNLEDYIALFSDNARAIFEEFEFGNTVIRLEKAGLLYKICQNFAKIDLHPDVVPDRVMSNIYEHLIRRFGAEVNEGAEDFMTPRDIVHLATALLLDPDDALFEASPGLIRTLYDPTCGTGGFLTDAMNHVGDYGNRDKIPPVLVPHGQELEPETHAVCVAGMLIRRLESDPGRDLSKNIRQGSTLSNDQFAGERFHYCLSNPPFGKKWEKDKTAVEAEHKKGELGRFGPGLPKISDGSMLFLMHLASKLELPINGGGRAAIVLSGSPLFNGGAASGESEIRRWLLEDDLIEAIVALPTDLFFRTNIATYLWILSNKKPQERKGKVQLINATDLWTSIRNEGNKRRIVSDEQRRQILDIYAAGETGALSRMLDYRTFGYRRIRVLRPLRMTLELDKVGMERLEAEAAWEKLSDAHQTFWREALKPLIGQTQPYSWAETFVSNSIKSDEAKQLKVKSNKTLITALINAFGHKDPKAEPVTDSNGELVPDTDLTDYENVPYLEDIDDYFAREVLPHVPDAWLDESFTDARDGQLGRVGYEINFNRFFYQYQPPRKLHDIDEDLKQVEAEIAALLAEVASE

SEQ ID NO: 285 - protein, 632 aa, Klebsiella pneumoniae; identical to SEQ ID NO: 203

SEQ ID NO: 286 - protein, 599 aa, Klebsiella pneumoniae
MTTQAPPSNLLPLNPEQLARLQAATTDFTPTQLAWVSGYFWGVLNQQSGAAVAAPAPAAEVPTITLISASQTGNARRVAEALRDDLLAAKLNVKLVNAGDYKFKQIAAEKLLVVVTSTQGEGEPPEEAVALHKFLFSKKAPKLDGTAFAVFGLGDTSYEFFCQSGKDFDNKLAELGAERLLDRVDADVEYQAAAAEWRARVVEALKARAPVAAPAQLATSGAVNDIHTSPYTKEAPLTATLSVNQKITGRNSEKDVRHIEIDLGDSGLRYQPGDALGVWYQNDPQLVKELVELLWLKGDEPVTVEGKTLPLSEALQWHFELTVNTATIVENYATLTRSESLVPLVGDKAQLQQYAAATPIVDMVRFSPAQLDAEALIGLLRPLTPRLYSIASSQAEVESEVHVTVGVVRYEIEGRARAGGASSFLADRVEEDGEVRVFIEHNDNFRLPANPETPVIMIGPGTGIAPFRAFMQQRAADGAQGKNWLFFGNPHFTEDFLYQVEWQSYVKEGLLTRIDLAWSRDQQQKIYVQDKLREQGAELWRWINDGAHIYVCGDANRMAKDVENTLLEVIAEYGAMDAEAADEFLSELRVERRYQRDVY

SEQ ID NO: 287 - protein, 119 aa, Klebsiella pneumoniae
PPQPNPTVWRSACPTGMSGWKRWPKTIPKFAGTSSISISCAPASCCSRSVLTWWSAPTCSAIFSPISARPVPALSALRRRPISIRSAISRRCSNRFTGRRRIFTVKISPTRSPPFGPGR

SEQ ID NO: 288 - protein, 107 aa, Klebsiella pneumoniae
CCSACWVGINTTARWSLSPSYSPAPVPARLTPCSRCQRRRKGAPCRILSPNVPTTSASRPICLGCSPKSTRRWPPPASFRSAGSAAAPTGWIPGRWPTAGRITPSCI

SEQ ID NO: 289 - protein, 114 aa, Klebsiella pneumoniae
PVPGSGWRRAEVRERHFRDFRPWQRPGAGAGAGAGQRRYARLSGAQRAGDGPRGHRFCPPGPAPADYRLHLLHRSGSGQHDHRRRHRQRQPHPTAAAAGRCLRHPPAGSGAPAD

SEQ ID NO: 290 - protein, 126 aa, Klebsiella pneumoniae
KMTRWSSASAFTASRASTAAASARWTKPSMRCSIPCWKTALTAARCASGIPSRARGRKYSRAKPRCKTATGLSRWLITSAPLRFPNCMACITALPSAAKRPASSSNATSSAATVLRWIWRASPSLC

SEQ ID NO: 291 - protein, 186 aa, Klebsiella pneumoniae
KAGRGAGDHLAGADRKYRPDRHLSDAGQGGCATAGGERLRAADLRLRAVYRRDPQQQPGAGGVVSGVRSRGIGVGQRQPVAVPRHGADEPQAVGVGLAGAADDYYPGGAGAGDGAVCGVRHLSDDGQKLRCRGAGSRALRVWPGGNADGDRQYAGDYRPFRAIAYGLPGSADGGGVLYRYRQRAGD

SEQ ID NO: 292 - protein, 25 aa, Klebsiella pneumoniae
RQRAAGAGGGGGARLQPPAGAGYRP

SEQ ID NO: 293 - protein, 121 aa, Klebsiella pneumoniae
GLPTFASTLNSRFIRSTMMSRCSSPIPAIMVWLDSSSVHTRKDGSSLARRPRARPIFSWSALVFGSTAMEITGSGNSIRSRMIGASGSHRVSPVVTSFRPIAAAMSPARTSLISSRLLACI

SEQ ID NO: 294 - protein, 216 aa, Klebsiella pneumoniae
TAAAGGPVSAGRAAGRRCGSHPFCSAPPPAGPVRDRRRTAAKNARLAGALRIALLTAPGVDARRAGPALATAGVERGAGGRAVADPPPAVGRHGGGKRLADGAAAERGGRARHRQLFAAARGAGRLAGAACADIADPCRTPSGSAETQSAAGGVRRPAAVCAGELASGAVCRAGSGVTGRGKQRAGPSRSGASGRGGATGQPGLLSPLVSDGEKGD

SEQ ID NO: 295 - protein, 56 aa, Klebsiella pneumoniae
RRRGLPASPCSGRDDPYAGAVRLYNRHRQPAAGSTLSPPRLPNMPHSTSCSARPTS

SEQ ID NO: 296 - protein, 71 aa, Klebsiella pneumoniae
KHPAEDGRRPGGAQRRQADAVAARQSGKGPASAVVRLPGSHPDAVEQRAQQRQAAAGSGRRAAGGGQYPGE

SEQ ID NO: 297 - protein, 98 aa, Klebsiella pneumoniae
SRPDAAAGSAGDCAALRRGGGGGRADRLCRAGGAARGAPSGDGRYPPGAAPGCAGGSAGAGAGGYRRPDAGRAAGAGDRGDDRPGGCAVVYLYRREVF

SEQ ID NO: 298 - protein, 41 aa, Klebsiella pneumoniae
PSGFRVALLKLNRTSDFRVKCLVATSGAGAGAGATTGAASS

SEQ ID NO: 299 - protein, 148 aa, Klebsiella pneumoniae
AAYPAGGAARRAGGDSGRGPALYPRVDSFSAGRGGYPHQAGGRPPSAVDVRRGGAGLPENLTGYHHPAGSGGGRFSRALRQPAAKHSGVAPGAGDDLRRPRPPDAALQQSAGEQPALYRQRRQPAHYRPPQRSHAGDCLRRQRPRRQR

SEQ ID NO: 300 - protein, 102 aa, Klebsiella pneumoniae
SAVASCPPYDFLQHHRPAAGAGGYGGDRPPGQPGIPRRRSGRGDGHQFPLHAAAVPAHEHHRAHRSGLGRQRSAAPGAGAGAAAGTGAGRRGADYPASPAAN

SEQ ID NO: 301 - protein, 53 aa, Klebsiella pneumoniae
TVLHHQSHRQRQRPGAVDGVWLCAPVWRPGGAGERAGAGDDGAAAAAASVDRG

SEQ ID NO: 302 - protein, 115 aa, Klebsiella pneumoniae
WPARHRSAQCAARSRCGAHPPGEPPPGAGGGAGYPFRPECADGRDARCSGTGRPYADLYRPQAGAADRQGAGCRRATPPSCAGARTLARRTKHSSDAVLRRPPRRLAAAAAGHLP

SEQ ID NO: 303 - protein, 31 aa, Klebsiella pneumoniae
CRALRGSVRTVRNNAIRSWKSWPARWRSRWC

SEQ ID NO: 304 - protein, 89 aa, Klebsiella pneumoniae
AVYPFRAGVYGGSEPPAGGHPRWTVPRRRPPLAVRLYPGIPGASGPVPAPVGSGHQPADQPGFAAAGAGPGGQSERALHPISRPASGVV

SEQ ID NO: 305 - protein, 70 aa, Klebsiella pneumoniae
ASGDPAGGAAGGSEGQRGAGAGGGAGERPGALAISRRDLAARQRKSQSGNSAGDSPRAPCPRAVWRHRAA

SEQ ID NO: 306 - protein, 48 aa, Klebsiella pneumoniae
FAKTTARSAWRWPMRWKAALASTWNSAARRGGCSCGRVSAIRSIPWNG

SEQ ID NO: 307 - protein, 56 aa, Klebsiella pneumoniae
TAPAPAAGKFTSKTASLPGKPSRPIIRAPGRICQITNRAAARAAPATPGISTAPTA

SEQ ID NO: 308 - protein, 107 aa, Klebsiella pneumoniae
GEGDVDINCIFGRNVNPAEPLYAAGDPAAVRQRPGPPGAAGDHAGRNGADVRRCLLAGDGRQRLGGESDPCRPRSGAGVLRPGRAESAFATRRATADLTPGSVGESA

SEQ ID NO: 309 - protein, 47 aa, Klebsiella pneumoniae
SADARSGTLPPRRRTSGLSGRRYGAAGLHSAAGWRLAGGPAAAGAAL

SEQ ID NO: 310 - protein, 61 aa, Klebsiella pneumoniae
SERRDIFIAAGGGGCRVRHCDASRTGGPGRDCQRHAGGGASGVDAEGVERLRHLSFPRLPT

SEQ ID NO: 311 - protein, 83 aa, Klebsiella pneumoniae
APVSTPAPAKPSGRSASRRSPAFTARSCSRRQTAAATPSAALSRIRSTSTLIATTSPLFPACAWCINRLSRKICPTLPPTAAY

SEQ ID NO: 312 - protein, 151 aa, Klebsiella pneumoniae
SADCSAAPGQPAGLAADWPAAVPEGGAGFQLDHFYLLHLADGDQHRGGCAADPAGLSQRRPRPPALGVDGDAQNPLSGGAAGGAYRRAPLHRHRLAGDRGGGNAHRRTGDRLLDLERVEQPQCGKHHHRHRHYRRRRPAAGAGPDAARSPL

SEQ ID NO: 313 - protein, 89 aa, Klebsiella pneumoniae
PPPSSARSCKIPPAATARKSSLKPCSSTGSWRWPPGCSAQSIRRKWPRMSPTLSIVSTSWSPHSTTPPSSVSNGWSGSIASSPLVWRCC

SEQ ID NO: 314 - protein, 45 aa, Klebsiella pneumoniae
VFSISSTCSPGRRPWLSSLSGPPSILASAPRRPGCFTRSTPLSPC

SEQ ID NO: 315 - protein, 38 aa, Klebsiella pneumoniae
LPRARPVSHWIRCVISPTTALARWASRLPPPQRSGARM

SEQ ID NO: 316 - protein, 32 aa, Klebsiella pneumoniae
IAVCPAGNAPVGQQPSHSHFRGDNGRGAGAGA

SEQ ID NO: 317 - protein, 103 aa, Klebsiella pneumoniae
QRGGGCRRGVAARRFRRYHHPDQQRRAGAVAAAGAGGGAGGLENDDRHQRHRSGDSHSRPAADADPPWRRGEYYQYRLDRRAVALSRQPCVWRQQGVCEAVQL

SEQ ID NO: 318 - protein, 51 aa, Klebsiella pneumoniae
CALPVAGARHTQVHAALWQSGRYRLCRRLGHHPPVEFPAHLFRYYPALKRP

SEQ ID NO: 319 - protein, 105 aa, Klebsiella pneumoniae
RSGLNGHDGRRAGDDGLCRTVYRPGGDGANHPSEHARRHRRIDRHLYAGHRRGGQLAGGRGRPANHRIANQRYGDCRLSAFLRADGRMDSRLRGGDGHYRLCRGL

SEQ ID NO: 320 - protein, 82 aa, Klebsiella pneumoniae
AVQPGTRRRRAAGVAGMGRQFSYGSLVREREKDPAGERELAGRPFGLRVAQHPELGGYGLWLRQPGGGGNPPDATAGRVDQR

SEQ ID NO: 321 - protein, 36 aa, Klebsiella pneumoniae
AITLGKNGYAGPVVQHRDLLSPAGAKPCLGRCIQGD

SEQ ID NO: 322 - protein, 56 aa, Klebsiella pneumoniae
IPSPGRGRRGNKGRGCRTALLNRPKIWWAGKTSRSSTSRQPARRGLWMTRSAHCSS

SEQ ID NO: 323 - protein, 135 aa, Klebsiella pneumoniae
LPSKAPSRAAVWAKSPAPKWPPRWSWRRKITATVSRPRRCCASKPAAYVCKRPTSVWPPSPIFMPRLSTCAATPRWSALLPVPSAASAVCPSPRRCAATLSSPVKPVSASMARRLSSRKPALKSTTPATVRLSGA

SEQ ID NO: 324 - protein, 91 aa, Klebsiella pneumoniae
RCRVRAHRCWLRMTARESPPRSASGCLSPLSALTPAGTGRQEAAASAWRLSTVSPRRWAARCAARPALSAAPASALAGRSIISCLISPLPE

SEQ ID NO: 325 - protein, 46 aa, Klebsiella pneumoniae
RSSAAGPGGRRGDSGRCAADHGLWPGAGGAQGAGADRPDIRPDGCH

SEQ ID NO: 326 - protein, 45 aa, Klebsiella pneumoniae
IVKYQPGRSGRFRLAQPAAHGAGPARRHSGAGDCAGADCRPERGG

SEQ ID NO: 327 - protein, 64 aa, Klebsiella pneumoniae
RHYVAVARRPGHRPAVRRRYGGRQRHDQRPACGGDCHRRHLPGRQYGRSLRRQNGRRAGAGGGR

SEQ ID NO: 328 - protein, 89 aa, Klebsiella pneumoniae
ARRGAGGHPAPARGAGRTAARAAADAGDGGPLRLRYLSPGAHCPGGGAVALLRLPGGGEVAERRRHVSGAHGHLPRHLYRTRSARRFIE

SEQ ID NO: 329 - protein, 61 aa, Klebsiella pneumoniae
LTAARRRSNFPSWAPPAATACSTAWPRASTRNGRLSRSTAASRWRWRSAATKAPCRRLPGH

SEQ ID NO: 330 - protein, 96 aa, Klebsiella pneumoniae
AFSGSPDAYYRDQYCSLAGAGPGADRYRQPAVDPACARTGSAVNHRHRFYRQPPGGAAGVPACGALQRNIVLASAAAAAPEGDWHHDGAGDQRESE

SEQ ID NO: 331 - protein, 152 aa, Klebsiella pneumoniae
PRERRWKLSPPAAASRRSPPRARAVNTERVPDAGVTSRPHRRPVPAVYYASGGHHSADGGYPAGRDHRLPLSAGLRPAGGRLPDHSGSHPLSGRQPGRGDLRHHRPAGAPVRPDVRPQADVVAKLWRRLGSHAAVPADPAAGRRRAGSAGGH

SEQ ID NO: 332 - protein, 118 aa, Klebsiella pneumoniae
RRHFESHFGVPPPNGAKHFVVWHDSTRRESIQGGKCETSNAIRCRRVCRCLLSDRFPRGEPGQPRLCENAGKGGSGDGAAELHSQPRGTTTGGQTVVADWRCYLQSGPARAVANCRGD

SEQ ID NO: 333 - protein, 67 aa, Klebsiella pneumoniae
RTQKPSRVLSGRLTEKSGQHRQTALTTPGSVTMNCGVRKSARLSHPEKVRVTGPVNMQTVTVQWLIS

SEQ ID NO: 334 - protein, 142 aa, Klebsiella pneumoniae
SVPLSRPDPAPVASRPPADRCGHDGSIRAESATDSSRPMPPDLILSPRLAERYAPHPPPGTTAHIASAPRRSYAGGQCSSQVSDQSLTWMPAPPASGFSAPARSARPTMLQPYRSAEPADNSGCGSVSVDCTIQTPADGAHK

SEQ ID NO: 335 - protein, 191 aa, Klebsiella pneumoniae
PAGEHRLHRFTLQQTGELGANVGFHQGVQRMARTLRVGAGAGAGAGGGRNTTVIGDLHNFVMQGVAQLADATSQRRGLLRQRQGGQRERRLYAAAAVVAAEHHPLHLKVVEGILQDAHDVVVGRVEHVGDIAVDKELAGLAAGEHLGGHAAVGAADPQRVGPLPVDPFFEIVRIMLTLLQRPAAVAGQQRF

SEQ ID NO: 336 - protein, 44 aa, Klebsiella pneumoniae
ARYPAPAGGSSARPPASRSAPAPTARQTRSAAASPPSTLPAPAG

SEQ ID NO: 337 - protein, 266 aa, Klebsiella pneumoniae
RCPAHRPSAGSPASPWAIAHPCVPVATFRSHPAETPSSQHHPQPPRHSAIAKAAPCGRDPQPAGKGHARPPAATAVATGRSSVYRSSSASSSSRRRSVCASRPSENERGFIPQRASQEKSAGTVDQDRVSSISPPLPCGRQAISFAPESGMAMGENDCVSMRAPGFSSPGMRSAMIRRHCVCNAASRVTAACGGRRSRQSATPPPDSPIASRIGSPVQVPRRLIRISARSRQGKTELPTPLGVALGPAGFCRRESRDASQRSLHAG

SEQ ID NO: 338 - protein, 172 aa, Klebsiella pneumoniae
KSKSLRRKQLFRVRQGVARDFAAAQQTGQLLQASTFIQRLHMGFGHLAIGLFADKEMMVAAACDLRQVGHAHHLRGLAQLAQQLADHGGGRAADADVHFVEDERRGFHFTRGDHLNRQRNARQFAAGGHFGDWLQRLTGVSGDAELNMVGVGGEMAFIERDLNREDPVRHRK

SEQ ID NO: 339 - protein, 110 aa, Klebsiella pneumoniae
PPANRVLISVGEPGCASPTWPSSASSCVTFTLSPSPRNRPTEEIPCFFAHASSVLLAVPASAPVMMSICSAGVTRRPFFFCTGRLSCFISSSTTQPPPWTIISGRWCASR

SEQ ID NO: 340 - protein, 467 aa, Klebsiella pneumoniae
RQHLRGLGRIGHQDRIHFPATANGAAQRAAVGARDRRFARRIDVQHQQGIHLGQHVGKIIIQIAGTGITVRLEYHHQVFIRPAGARCFNGGVHFRRVVTVIIDQHRAARFAVDFGQRKLAKKIKAASSSLEALQCAQNSPIVNPLFRRHGDGRRRVQRVMASRGIERHLQDRFILAHQAEMPLRPNLTIVLDAYVGVVAKTVGGDLPANARQQFPDHRIVHAHHRASVERQVVQEVDKGLLQILEVAMVGIHVIGFDVSDNGHHRLQMQKRRVALIRFRDQVTAMAKAGMYARRFYQPAVDKGRVQPGLGVNAGYHRGGGGFAVGPGNGDPVAKAHKFRQHFGTTDHRDTRLMRGNDFRVICRNRAGNDNHAGITHVFRAMVEINGGAKLRQLLGHRIRRQVGAADLVTFVSQHFGNTAHTGTADADKVNVPNATHLGHYGTQFCQILCIHSLRHQLLYSGGENHRN

SEQ ID NO: 341 - protein, 249 aa, Klebsiella pneumoniae
SRLQRCQKKREPSCSRFYFAVLPAALARGGQQTIRAEHRLDTADRLARTVPVLDQGEADVGITIVAKANPRRDANLRFIKQLFRKLQRPHGGVRFRYFRPHVHRRFRTLHHPAGLMKPFDQHIATALILFGNIAHALLIALQRSYRRHLQRSKSPVVMIAFDTSEGIHQSLITHHKANAPAGHVIAFRQGKELDGDIPRAGHLHDGGRFPAVIHDIGIGQIVDDQNVILLRQSDNLFKEIQFDALRGRI

SEQ ID NO: 342 - protein, 82 aa, Klebsiella pneumoniae
RYAQSASPLSQSRASQTARHTAGADTGRPSGSDRRAGSRAFRLPRRPDGSAEYGGSPGAPAHRPPPPPPDRFYPYPPDPRRK

SEQ ID NO: 343 - protein, 264 aa, Klebsiella pneumoniae
ECCDDQLAQELPFTRWISISRGLSSRRALLTGGRDSMLDSATSATQVPSANRNSPHTRAVVRRLRPDGALATVGAGGGAAASGRGTETSDGAPAAGGAGTAVDGEGVSASIDGASSSPSSVHQITGTVSLYPRLGTVAMYSRLTSSPSLSDLRSSEILCVTTWLVTTFRVQTFSISSSRLSTSPGWRAKKTRRSIKRGSRVSWRPFLLIWFTEGVTSHSPTRTTGCSIQESPRQKGKGAMITHLSYLFLPGVTPSGIRPELALY

SEQ ID NO: 344 - protein, 254 aa, Klebsiella pneumoniae
QIKLRQTDHHHDAVGSHLLLVFQQRGQLIVKKQAVIQSGFRILRRVGANKRIHPAALIAGELQLRQQHIQRATGAGRPFIDRPAHLRPALAAQDTRGTQLQQLLAGQLAADPADGEENNHHHEANGDRQRGSDRQRTEIVHHRVNVDQMQRNARMFKRRNRDLTELLMAAERAIAIGSGMAVERFAVEHEIDMHDLDRRHQLIQLRFKLIERGGDEPVIQHGRHRLNAVFDLVLNAVIKTQRSANQRDKDGQAS

SEQ ID NO: 345 - protein, 286 aa, Klebsiella pneumoniae
DFGSVGFQAGGFQRVAHSAHLFPGGVDVDGAVVIGHHVFCACFQRRFHDSVFIAFLEGDNAFLAEQVGDGTVGAEVTPGFGEGVTHFRNGTVTVVGQTFHHHRGAARTVAFINDGFHVRVFIAADAARDGAVQGVASHVVRQRFINGRTQTRVGSRIAAAQTRGGDQLANDFRKDFTAFGILCRFAVFGVGPFTMTCHKKLSKKRALSGGVNYKFFNRLPVAPRLGQRSGFRRADPAIGQMFGESNLPLMRQRKTEPEFRIALYTRRIAMTQMRKYLELHRALTVD

SEQ ID NO: 346 - protein, 51 aa, Klebsiella pneumoniae
SLAAGAVRVRPAAAAFRRRAGDRADGRRPSPAPAPAAGARVRPSRGSAPAY

SEQ ID NO: 347 - protein, 100 aa, Klebsiella pneumoniae
FIALAQSLNTGLALRVMPMDHHQRLALLPHHLTILAKPLAVGIKHRQPVAKARRDVTVDKLLPLFSGDVFPRRAAQTEVKRGLHHGLIRRADAGLRRAGR

SEQ ID NO: 348 - protein, 68 aa, Klebsiella pneumoniae
ASEFGQPPAIALADTARCSLRSPPPGRSAVGELAKAGLATRKYAWIPSRACGRQPSAADRAGARPGAK

SEQ ID NO: 349 - protein, 107 aa, Klebsiella pneumoniae
MSNDRVRRSAASLTFCSSSLSDRQTGCRWPRRRSFAHLPLPPPWSHTDRLRCTWNVRDRDSTGTTSPSCCHLPGYWSGRDRCGAPSARADWSRQTPVSSVRTPREKA

SEQ ID NO: 350 - protein, 72 aa, Klebsiella pneumoniae
SPSAGSPQTDCKTAAGVPDARSPEWCSGLHRGIRRTVRLPGSCAGECNGIPRGSPPLSARRSVCCDPRYHAA

SEQ ID NO: 351 - protein, 26 aa, Klebsiella pneumoniae
SDRGRQTPGSPAHGGAGPSAGHTLPG

SEQ ID NO: 352 - protein, 44 aa, Klebsiella pneumoniae
RHSHSTGPWRKRRSQSDETRRLTAQMGGTKASSCRRSKRINSPR

SEQ ID NO: 353 - protein, 105 aa, Klebsiella pneumoniae
FFRQLYFNGVGVPLFQLLGNRPLNVFVEKRVLAPAALQGAKMGFIPGRIAQRDGDITQPAQVANATNRRPFGHLQKPRFAPGEQLHQRRGMQRFAWAEILFIGEL

SEQ ID NO: 354 - protein, 187 aa, Klebsiella pneumoniae
ANPDRNRGGHCAEDDQGTEEAAGGVTGPHHHVGAVGGIALVDGELTRQNDDVAHRQAEDQAGDQRRGEVRHREDKARAEQQRRHAKTDTGLYRAADIEDPYQRPFDDAGEQEAGAKRRHRAVNAGINPRLQHRHEGHFVKGADAVQVVHVGPGEDAGGEQANKDRERPVGIPKTFILFHYPAPVTCR

SEQ ID NO: 355 - protein, 120 aa, Klebsiella pneumoniae
MTSKTARRRRRAAKSSSKKRAPGGPFCVWLNGRLPPDYSPGDSTVHSAGKTIHDVLHPYCRQWPEDQLAGPGRAFWRNSAPKNQNSSLNTYRYGSCAYSFSGGCSDQSYAFYSLQYLRLP

SEQ ID NO: 356 - protein, 49 aa, Klebsiella pneumoniae
TLTVTRPASPGRQGSRRKGMFVSQPVPEAEGPPAASAGETGSITARTAD

SEQ ID NO: 357 - protein, 77 aa, Klebsiella pneumoniae
WCRLSRRRPGLQRQCTLSVLCVPPSAAVSPAQRGVCAALSRTLCCRAARFLPPCRPDYRFSCCPSPCSVLPRYPFEV

SEQ ID NO: 358 - protein, 113 aa, Klebsiella pneumoniae
NDTSDNRLSVGVLRINKSPFYPLRTAKIGRQQRSAQQRKQQLTQGKHIRDRREGKSLYRQQQGDEQPDNIVFRHHRAPLEKGDSQPERVIPHGEGKQQRGDPQRHMARAHGAQ

SEQ ID NO: 359 - protein, 132 aa, Klebsiella pneumoniae
KHTAKAGFVAGIALPQGLREPLILAVHRRLLLARQRRMRLAAGRLLTDPRMGAERRVQLILSPVSHRLPGGLQQRMAAGERSQAHQRLAPGRERHAGGQQPRRLIFTQAVKLTQRDHPDSLSFSSPPAPAAE

SEQ ID NO: 360 - protein, 77 aa, Klebsiella pneumoniae
SLQSCAILSVVCGVIRARCAFCVGGETVSLQPARSSTSMTETTPFTTFSSTALLASCYPKDSVLQVFCEYHETATSL

SEQ ID NO: 361 - protein, 166 aa, Klebsiella pneumoniae
TSIRRASSSIEALARIRASSWSIMSLLSRRSLRTPSSYRPLFLLPPVTPRVETSASPGPFTTQPMIETSIGVMISSRRCSRAFTVPITSNSWREQVGQAIKLMPRERIRRDLRISKPTLISSTGSAASETRSVSPIPSDSSSPRPIADFTAPLRAPPASVIPRCSG

SEQ ID NO: 362 - protein, 104 aa, Klebsiella pneumoniae
PARAGCAPPRRFPPVPPGPPLREPPGRRPVFGYSPAAVQSAFAGYGYCCRGSRQSPAAQGSGAPRPGRPTARYLHAYWPTGFSAHATDGEEIDAAATPATPGAR

SEQ ID NO: 363 - protein, 26 aa, Klebsiella pneumoniae
TAPGMPPARRGSWRALPANRWSSAPG

SEQ ID NO: 364 - protein, 141 aa, Klebsiella pneumoniae
LRIDVKQQAGEEGGHRPAQRAPHPRPAEFKLALTRHPLGVRFQHADAAVKGQTDIDPAKDAAQQDVDFQQVAEQQIRRTREDQQRGDIPEQMFAQPQLVLDKSIANLRKQRGNRQYGIDNTGIASLQPNLLVKPDREQGAG

SEQ ID NO: 365 - protein, 75 aa, Klebsiella pneumoniae
CRGAPASRSGCRRNGRHGPAAAAQSHRRPCGKPGCGRKEPGNRRAECGRGRWREFHGQSLSRYSLPARQRRTCAR

SEQ ID NO: 366 - protein, 68 aa, Klebsiella pneumoniae
VARRSCAVFRKSALSISTFAPRLPGSRARQRTLCGIPNRSRAAPLSGSSGIASAMVWPIKRQGTLNLS

SEQ ID NO: 367 - protein, 48 aa, Klebsiella pneumoniae
PNAPRCHQVNSHLPPASRRHLSAAPGFRNAPPGRCHGRRRRCGRAKRR

SEQ ID NO: 368 - protein, 159 aa, Klebsiella pneumoniae
PPDGFQRWPADADPAGFDRMKNRGDEQALPGRYRPGASKPAEFCRCRYSRQSARSAAAPVRRWPGSPPGVALYSRRRSGGNPRQLLSATAGRYASAGRRGRSTGNRVGNGRTLPATPEYGWRAGHPGPVYGRAPAPLPAPDACSRCRPRRVLHHSSAAG

SEQ ID NO: 369 - protein, 101 aa, Klebsiella pneumoniae
CSCGFFPVTAVISAASRHMMMPSLSVDHGVPSKRRKEAPALSSPPKPKLPSNRPSTNHLKPTGTSTSLRPRSFTTRSIIAEETSVLPTATSLPHCGRCWNR

SEQ ID NO: 370 - protein, 85 aa, Klebsiella pneumoniae
HTTASRIPATLPIGVLRLSTPPPTFASATTVSTGRPTAVIRKPIAAVQTCSPACKPTIGGKIMLPAPTNNAKVIKPNAMMSRDFN

SEQ ID NO: 371 - protein, 167 aa, Klebsiella pneumoniae
SGFPARADAFYYASASGADHTAAAPNCRGQAEESCSGPPTATTTGASNSRNARSANRSLPPVKTTADAPQTPPESGPEYTLKRAPAPAFSMTAVPARVTLLSKFRNGRRNDTPCREPFAPYDHGHCVPALCAGGEYGRPPCGLPHKRWSPRRGSAAVRGCTPAPDGS

SEQ ID NO: 372 - protein, 105 aa, Klebsiella pneumoniae
KHDSNNKRNFGGTFPCFEGFVKVAKVHHQMANTDNDVIGQRGENAPHDELHKEAIHDGGRRQKTFWGGKAGAQQPKQNSDRHEGDDTGNAMENGRYRRDWEPYRL

SEQ ID NO: 373 - protein, 162 aa, Klebsiella pneumoniae
SVAISPGVRWAAVRIAAQATGLRLCGIVDEPPRPSATGSPTSATSVCISREKSLANFPSVPQTPANQAPASSSRSRWLCHGVSGSDRPRICASARPTAGPFSFSASRVPAAPPNCSASSRGRISRSRCCQRRSASRVPASFRPKVTGSACCIQVRPGITVSR

SEQ ID NO: 374 - protein, 116 aa, Klebsiella pneumoniae
PPPAPAPPPPTASLPAADTARRRPPAPRCRGWHFHTVWRYGTAAASRPGALHTECRWCRAAPSGSRGCTPPGAPYGLCSPYSGGCRSCAASATSTSTGTRCRQDRSPAAHGAETSI

SEQ ID NO: 375 - DNA, 1125 bp, Klebsiella pneumoniae
ggccagctcggctgccgcgtcctgctgctggataacggcaaaaagccggggcgaaaaattctgatgtccggcggcggccgctgcaactttaccaacatgtatgttgaaccgacggcctatttgagccaaaacccgcatttttgcaaatctgccctggcgcgctacacccagtgggactttatcgagctggtcggcaaatatggcatcgcctggcatgagaagaccctcggccagctgttttgcgatgattcggcggagcagatcgtcaatctgctgctcgcggaatgtgaaaagggcggcgtgcagatccgtctgcgcagcgaaatcctcagcgtggagcgcgatgaacaaggctaccggctacaggtgaacggcgaaacgctgatgaccaaaaagctggtgatcgcctccggcggtctgtcgatgccggggctcggcgcctcgccgtttggctataaagtcgccgagcagttcggcctgaaggtgctgccgacccgcgcggggctggtgccgtttaccctccacaagccattgcttgagcagctgcaggtcctctccggcgtgtcggtgccgtcgaccattaccgccgagaacggcactctgtttcgcgaaaatctgctgttcacccaccgcggcctttccggaccggcggtgctgcaaatttccagctactggcagcccggcgagttcgtcaccgttaatctgctaccggactgcgatcttgatgacttccttaacgagcagcgcagcgcgcatcccaaccagagcctgaagaacaccctggcgatgcagctgccgaagcggctggtggagtgtctgcagcagctggggcagatacctgatgtgacgctcaagcaactgaacgttcgcgatcagcagacgctggtggagacgttaaccgcctggcgcgtgcagccgaacggcaccgaaggctaccggacggcggaggtgaccctcggcggcgtggacaccaacgaactctcgtcgcgtactatggaggcgcgtaaggcgccgggtctctactttatcggcgaagtgatggacgttaccggctggctcggggggtataacttccagtgggcgtggtcaagcgcctgggcctgcgcgcaggcgctggtggaaggg

SEQ ID NO: 376 - protein, 375 aa, Klebsiella pneumoniae
GQLGCRVLLLDNGKKPGRKILMSGGGRCNFTNMYVEPTAYLSQNPHFCKSALARYTQWDFIELVGKYGIAWHEKTLGQLFCDDSAEQIVNLLLAECEKGGVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 377 - DNA, 18 bp, Artificial Sequence
  Primer 210-5901
gtgctggcggttatcctg

SEQ ID NO: 378 - DNA, 20 bp, Artificial Sequence
  Primer 210-5902
gttattcccgggtcgaaatc

SEQ ID NO: 379 - DNA, 20 bp, Artificial Sequence
  Primer 210-5903
acgcagaagaaaccgaacag

SEQ ID NO: 380 - DNA, 20 bp, Artificial Sequence
  Primer 210-5904
cgacggaataaagtgggaat

SEQ ID NO: 381 - DNA, 24 bp, Artificial Sequence
  Primer 210-6097
gaccagagtgaaatatttacaaaa

SEQ ID NO: 382 - DNA, 18 bp, Artificial Sequence
  Primer 210-6563
gtttatcgccacgctgat

SEQ ID NO: 383 - DNA, 20 bp, Artificial Sequence
  Primer 210-5905
gcctgatggctgaatcgtta

SEQ ID NO: 384 - DNA, 19 bp, Artificial Sequence
  Primer 210-5906
gagcagcgttttgttgtcg

SEQ ID NO: 385 - DNA, 25 bp, Artificial Sequence
  Primer 210-6345
caagctgaagctgttgggtgtggac

SEQ ID NO: 386 - DNA, 22 bp, Artificial Sequence
  Primer 210-6346
ggcggtgcggatgtagaacatc

SEQ ID NO: 387 - DNA, 20 bp, Artificial Sequence
  Primer 210-5909
ggctggaacctgtacgtttg

SEQ ID NO: 388 - DNA, 20 bp, Artificial Sequence
  Primer 210-5910
tcgtcgatgctgcagatatt

SEQ ID NO: 389 - DNA, 19 bp, Artificial Sequence
  Primer 210-5911
ccgcttcgtcactgttgag

SEQ ID NO: 390 - DNA, 20 bp, Artificial Sequence
  Primer 210-5912
tgactgacaaaggcggagag

SEQ ID NO: 391 - DNA, 20 bp, Artificial Sequence
  Primer 210-5913
cgctgaacgtcgataatgtc

SEQ ID NO: 392 - DNA, 20 bp, Artificial Sequence
  Primer 210-5914
gaaccacctcgagtttcacc

SEQ ID NO: 393 - DNA, 18 bp, Artificial Sequence
  Primer 210-5915
cgcgcgatctctatcgtc

SEQ ID NO: 394 - DNA, 20 bp, Artificial Sequence
  Primer 210-5916
gagaccggagatcgcttttt

SEQ ID NO: 395 - DNA, 20 bp, Artificial Sequence
  Primer 210-5917
gccgcgtttgatatcgtcta

SEQ ID NO: 396 - DNA, 20 bp, Artificial Sequence
  Primer 210-5918
cgttttaactcgtcgccatc

SEQ ID NO: 397 - DNA, 20 bp, Artificial Sequence
  Primer 210-5919
gtggatagcggggtactgaa

SEQ ID NO: 398 - DNA, 20 bp, Artificial Sequence
  Primer 210-2920
gcccctctctatcccatagc

SEQ ID NO: 399 - DNA, 19 bp, Artificial Sequence
  Primer 210-5921
taaaggcgctgggcattag

SEQ ID NO: 400 - DNA, 20 bp, Artificial Sequence
  Primer 210-5922
ggctgactgccggtattact

SEQ ID NO: 401 - DNA, 19 bp, Artificial Sequence
  Primer 210-5923
aaccaacgccttgttcctt

SEQ ID NO: 402 - DNA, 20 bp, Artificial Sequence
  Primer 210-5924
gtgaccggataacgccagac

SEQ ID NO: 403 - DNA, 20 bp, Artificial Sequence
  Primer 210-5925
gtaaggacatgcaggagatg

SEQ ID NO: 404 - DNA, 19 bp, Artificial Sequence
  Primer 210-5926
gtaatatggcgacggtctt

SEQ ID NO: 405 - DNA, 20 bp, Artificial Sequence
  Primer 210-5927
cattaggctagtcgttctcg

SEQ ID NO: 406 - DNA, 20 bp, Artificial Sequence
  Primer 210-5928
tacgttcctgttaccgtgtc

SEQ ID NO: 407 - DNA, 21 bp, Artificial Sequence
  Primer 210-6564
gacgtcagtttactggtaggc

SEQ ID NO: 408 - DNA, 20 bp, Artificial Sequence
  Primer 210-6565
tctttcagctgacgaatgac

SEQ ID NO: 409 - DNA, 22 bp, Artificial Sequence
  Primer 210-6566
ctcgtaataacgctctataccc

SEQ ID NO: 410 - DNA, 18 bp, Artificial Sequence
  Primer 210-6567
caatagccggaatggata

SEQ ID NO: 411 - DNA, 21 bp, Artificial Sequence
  Primer 210-6568
ctgatgatcctgattaacgac

SEQ ID NO: 412 - DNA, 19 bp, Artificial Sequence
  Primer 210-6569
cgattttacgctccatcat

SEQ ID NO: 413 - protein, 356 aa, Klebsiella pneumoniae MGH78578; identical to SEQ ID NO: 216

SEQ ID NO: 414 - protein, 356 aa, Klebsiella pneumoniae A5054
MKMKLTALMSGIILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKH

SEQ ID NO: 415 - protein, 356 aa, Klebsiella pneumoniae i225/94
MKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKQ

SEQ ID NO: 416 - protein, 356 aa, Klebsiella pneumoniae D5050
MKLILTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKH

SEQ ID NO: 417 - protein, 356 aa, Klebsiella pneumoniae E5051
MKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKH

SEQ ID NO: 418 - protein, 356 aa, Klebsiella pneumoniae Aerogenes4140
MKMKLTALMSGMILSSSALCFSATAADKMVIAHRGASGYLPEHTLPAKAMAYAQGTDYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKQ

SEQ ID NO: 419 - protein, 356 aa, Klebsiella pneumoniae 1015; identical to SEQ ID NO: 216

SEQ ID NO: 420 - protein, 356 aa, Klebsiella pneumoniae 919
MKMKLTALMSGIILSSLPLCFSATAADKMVIAHRGASGYLPEHTLPAKAMAYAQGADYLEQDLVMTKDDRLVVLHDHYLDRVTDVAQRFPQRARQDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKH

SEQ ID NO: 421 - protein, 356 aa, Klebsiella pneumoniae 313
MNMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 422 - protein, 356 aa, Klebsiella pneumoniae 1470
MSVNFPALMIVMILSSSALCFSATAADKMVIAHRGASGYLPEHTLPAKAMAYAQGTDYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPAKAVQFLDAKL

SEQ ID NO: 423 - protein, 356 aa, Klebsiella pneumoniae Mich61
MKMKLTALMSGIILSSSALCFSATAADKMVIAHRGASGYLPEHTLPAKAMAYAQGADYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 424 - protein, 356 aa, Klebsiella pneumoniae 2069/49
MKMKLTALMSGIILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 425 - protein, 356 aa, Klebsiella pneumoniae 2005/49
MKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKYVQTYPGRFPMGKSDFRIHTFEEEIEFVQGLNHSTGKNIGIYPEIKAPWFHHQEGKDITASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKQ

SEQ ID NO: 426 - protein, 356 aa, Klebsiella pneumoniae 1754/49
MKMKLTALMSGMILSSSALCFSATAADKMVIAHRGASGYLPEHTLPAKAMAYAQGADYLEQDLVMTKDDRLVVLHDHYLDRVTNVAQRFPQRARQDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKH

SEQ ID NO: 427 - protein, 356 aa, Klebsiella pneumoniae 1702/49; identical to SEQ ID NO: 415

SEQ ID NO: 428 - protein, 356 aa, Klebsiella pneumoniae i202/94
MNMKLTTLMSGMMLASSALCFSATAADKMVIAHRGASGYLPEHTLPAKAMAYAQGADYLEQDLVMTKDDRLVVLHDHYLDRVTDVAQRFPQRARQDGRFYAIDFTLAEIKSLKFTEGFEPKDGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGQWVNYSYDWMFKPGAMAQIAQYADGIGPDYHMLVAEGSKPGAVKLTAMVKEAHASHLQVHPYTVRADQLPEYATNVNQLYDLLYNQAGVDGLFTDFPDKAVQFLDAKR

SEQ ID NO: 429 - protein, 356 aa, Klebsiella pneumoniae 1996/49; identical to SEQ ID NO: 418

SEQ ID NO: 430 - protein, 356 aa, Klebsiella pneumoniae 1680/49
MRMKLTALMSVMILSSSALCFSATAADKMVIAHRGASGYLPEHTLPAKAMAYAQGADYLEQDLVMTKDDRLVVLHDHYLDRVTDVAQHFPQRARQDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVVYNQAGAIGVVTDFPAKAVQLGNAIL

SEQ ID NO: 431 - protein, 356 aa, Klebsiella pneumoniae 2002/49; identical to SEQ ID NO: 415

SEQ ID NO: 432 - protein, 356 aa, Klebsiella pneumoniae 6613
MNMKLTALMSGMILASSALCFSAVAAEKMDIAHRGASGYLPEHTLPAKAMAYAQGADYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFQPGAMAQIAQYADGIGPDYHMLVAEGSKPGAVKLTAMVKEAHASHLQVHPYTVRADQLPEYATNVNQLYDLLYHQAGVDGLFTDLPAKAVQFRDAKQ

SEQ ID NO: 433 - protein, 356 aa, Klebsiella pneumoniae 5758
MNMKLTALMSGMILASSALCFSAVAAEKMVIAHRGASGYLPEHTLPAKAMAYAQGADYLEQDLVMTKDDRLVVLHDHYLDRVTDVAQRFPQRARKDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFQPGAMAQIAQYADGIGPDYHMLVAEGSKPGAVKLTAMVKEAHASHLQVHPYTVRADQLPEYATNVNQLYDLLYHQAGVDGLFTDFPDKAVQFLDAKQ

SEQ ID NO: 434 - protein, 356 aa, Klebsiella pneumoniae 7824; identical to SEQ ID NO: 415

SEQ ID NO: 435 - protein, 356 aa, Klebsiella pneumoniae 6258; identical to SEQ ID NO: 415

SEQ ID NO: 436 - protein, 356 aa, Klebsiella pneumoniae 6168
MKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKH

SEQ ID NO: 437 - protein, 356 aa, Klebsiella pneumoniae i256/94; identical to SEQ ID NO: 216

SEQ ID NO: 438 - protein, 356 aa, Klebsiella pneumoniae 7749; identical to SEQ ID NO: 417

SEQ ID NO: 439 - protein, 356 aa, Klebsiella pneumoniae 5281
MKMKLTALMSGMILSSSPLCFSATAADKMVIAHRGASGYLPEHTLPAKAMAYAQGADYLEQDLVMTKDDRLVVLHDHYLDRVTDVAQHFPQRARQDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLHANR

SEQ ID NO: 440 - protein, 356 aa, Klebsiella pneumoniae i224/94
MKMKLTALMSGIILSSSALCFSATAADKMVIAHRGASGYLPEHTLPAKAMAYAQGADYLEQDLVMTKDDRLVVLHDHYLDRVTDVAQRFPQRARQDGRFYAIDFTLAEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 441 - protein, 356 aa, Klebsiella pneumoniae 3985/51; identical to SEQ ID NO: 415

SEQ ID NO: 442 - protein, 356 aa, Klebsiella pneumoniae i221/94
MTMNFPALMIVMIPSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFGDAKL

SEQ ID NO: 443 - protein, 356 aa, Klebsiella pneumoniae 4463/52
MNMKLTALMSGMMLASSALCFSATAADKLDIAHRGASGYLPEHTLPAKAMAYAQGADYLEQDLVMTKDDRLVVLHDHYLDRVTDVAQRFPQRARQDGRFYAIDFTLAEIKSLKFTEGFEPKDGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGQWVNYSYDWMFKSGAMAQIAQYADGIGPDYHMLVAEGSKPGAVKLTAMVKEAHASHLQVHPYTVRADQLPEYATNVNQLYDLLYNQAGVDGLFTDFPDKAVQFLDAKR

SEQ ID NO: 444 - protein, 356 aa, Klebsiella pneumoniae 5710/52; identical to SEQ ID NO: 424

SEQ ID NO: 445 - protein, 356 aa, Klebsiella pneumoniae 5711/52; identical to SEQ ID NO: 418

SEQ ID NO: 446 - protein, 356 aa, Klebsiella pneumoniae 5845/52; identical to SEQ ID NO: 216

SEQ ID NO: 447 - protein, 356 aa, Klebsiella pneumoniae NCTC8172
MKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDILYNQAGVDGLFTDFPDKAVQFLDAKR

SEQ ID NO: 448 - protein, 356 aa, Klebsiella pneumoniae 708
MKMKLTALMSGIILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKQ

SEQ ID NO: 449 - protein, 356 aa, Klebsiella pneumoniae 370; identical to SEQ ID NO: 448

SEQ ID NO: 450 - protein, 356 aa, Klebsiella pneumoniae Friedlaender204; identical to SEQ ID NO: 425

SEQ ID NO: 451 - protein, 356 aa, Klebsiella pneumoniae 5053; identical to SEQ ID NO: 423

SEQ ID NO: 452 - protein, 168 aa, Klebsiella pneumoniae MGH78578; identical to SEQ ID NO: 191

SEQ ID NO: 453 - protein, 168 aa, Klebsiella pneumoniae A5054
VPVTEPSSRRSGYARLLDRAIRILAMRDHSEQELRRKLVAPVMSKNGPEALDVTPDELEQVVAWCIENRYLDDNRFVGQFIASRSRKGYGPARIRQELSQKGIARQVVDQAMRKCDIDWVSLAREQAQRKYGEPLPSAFTEKVKVQRFLLYRGYLMEDIQEIWRNFAD

SEQ ID NO: 454 - protein, 168 aa, Klebsiella pneumoniae B5055
VPVTDPSSRRSGYARLLDRAIRILAMRDHSEQELRRKLVAPVMSKNGPEALDVTPDELEQVVAWCIENRYLDDNRFVGQFIASRSRKGYGPARIRQELSQKGIARQVVDQAMRECDIDWVSFAREQAQRKYGEPLPSAFTEKVKVQRFLLYRGYLMEDIQEIWRNFAD

SEQ ID NO: 455 - protein, 168 aa, Klebsiella pneumoniae i225/94; identical to SEQ ID NO: 191

SEQ ID NO: 456 - protein, 168 aa, Klebsiella pneumoniae D5050; identical to SEQ ID NO: 191

SEQ ID NO: 457 - protein, 168 aa, Klebsiella pneumoniae E5051; identical to SEQ ID NO: 191

SEQ ID NO: 458 - protein, 168 aa, Klebsiella pneumoniae Aerogenes4140; identical to SEQ ID NO: 191

SEQ ID NO: 459 - protein, 168 aa, Klebsiella pneumoniae 1015; identical to SEQ ID NO: 191

SEQ ID NO: 460 - protein, 168 aa, Klebsiella pneumoniae i262/94
VPVTEPSSRRSGYARLLDRAIRILAMRDHSEQELRGKLAAPVMSKNGPEALDVTPEELEQVVAWCIENRYLDDNRFVGQFIASRGRKGYGPARIRQELSQKGIARQVVDQAMRECDIDWVSLAREQAQRKYGEPLPSAFTEKVKVQRFLLYRGYLMEDIQEIWRNFAD

SEQ ID NO: 461 - protein, 168 aa, Klebsiella pneumoniae 919
VPVTEPSSRRSGYARLLDRAIRILAMRDHSEQELRRKLVAPVMSKNGPEALDATPDELEQVVAWCIENRYLDDNRFVGQFIASRSRKGYGPARIRQELSQKGIARQVVDQAMRECDIDWVSLAREQAQRKYGEPLPSAFTEKVKVQRFLLYRGYLMEDIQEIWRNFAD

SEQ ID NO: 462 - protein, 168 aa, Klebsiella pneumoniae 313; identical to SEQ ID NO: 461

SEQ ID NO: 463 - protein, 168 aa, Klebsiella pneumoniae 1470; identical to SEQ ID NO: 191

SEQ ID NO: 464 - protein, 168 aa, Klebsiella pneumoniae 1193; identical to SEQ ID NO: 191

SEQ ID NO: 465 - protein, 168 aa, Klebsiella pneumoniae Mich61; identical to SEQ ID NO: 453

SEQ ID NO: 466 - protein, 168 aa, Klebsiella pneumoniae 2069/49; identical to SEQ ID NO: 191

SEQ ID NO: 467 - protein, 168 aa, Klebsiella pneumoniae 2005/49
VPVTDPSSRRSGYARLLDRAIRILAMRDHSEQELRRKLVAPVISKNGPEALDVTPDELEQVVAWCIEKRYLDDNRFVGQFIASRSRKGYGPARIRQELSQKGIARQVVDQAMRECDIDWVSLAREQAQRKYGEPLPSAFTEKVKVQRFLLYRGYLMEDIQEIWRNFAD

SEQ ID NO: 468 - protein, 168 aa, Klebsiella pneumoniae 1754/49; identical to SEQ ID NO: 191

SEQ ID NO: 469 - protein, 168 aa, Klebsiella pneumoniae 1702/49
VPVTDPSSRRSGYARLLDRAIRILAMRDHSEQELRRKLVAPVMSKNGPEALDVTPDELEQVVAWCIENRYLDDNRFVGQFIASRSRKGYGPARIRQELSQKGIARQVVDQAMRECDIDWVSLAREQAQRKYGEPLPSAFTEKVKVQRFLLYRGYLMEDIQEIWRNFAD

SEQ ID NO: 470 - protein, 168 aa, Klebsiella pneumoniae i202/94
VPVTEPSSRRSGYARLLDRAIRILAMRDHSEQELRRKLAAPVMSKNGPEALDVTPEELEQVVAWCIENRYLDDNRFVGQFIASRSRKGYGPARIRQELSQKGIARQAVEQAMRECDIDWVSLARAQAQRKYGEPLPSAFAEKVKIQRFLLYRGYLMEDIQEIWRNFAD

SEQ ID NO: 471 - protein, 168 aa, Klebsiella pneumoniae 1996/49; identical to SEQ ID NO: 191

SEQ ID NO: 472 - protein, 168 aa, Klebsiella pneumoniae 1680/49; identical to SEQ ID NO: 191

SEQ ID NO: 473 - protein, 168 aa, Klebsiella pneumoniae 2002/49; identical to SEQ ID NO: 191

SEQ ID NO: 474 - protein, 168 aa, Klebsiella pneumoniae 6613
VPVTEPSSRRSGYARLLDRAIRILAMRDHSEQELRRKLVAPVMSKNGPEALDATPDELEQVVAWCIENRYLDDNRFVGQFIASRSRKGYGPARIRQELSQKGIARQVVDQAMRKCDIDWVSLAREQAQRKYGEPLPSAFTEKVKVQRFLLYRGYLMEDIQEIWRNFAD

SEQ ID NO: 475 - protein, 168 aa, Klebsiella pneumoniae 5758; identical to SEQ ID NO: 474

SEQ ID NO: 476 - protein, 168 aa, Klebsiella pneumoniae 5725y
LPVTETSSRRSDYARLLDRAIRILAMRDHSEQELRRKLAAPVMSKNGPEALNVTPEEVDNVVEWCIENRYLDDERFVRQFIASRSRKGYGPARVRQELKQKGISRETIEAAMRECEIDWAQLAKEQAQRKYGEPLPTVFAEKVKIQRFLLYRGYLMEDIQEIWRNFAD

SEQ ID NO: 477 - protein, 168 aa, Klebsiella pneumoniae 7824
VPVTDASSRRSGYARLLDRAIRILAMRDHSEQELRRKLVAPVMSKNGPEALDVTPDELEQVVAWCIENRYLDDNRFVGQFIASRSRKGYGPARIRQELSQKGIARQVVDQAMRECDIDWVSLAREQAQRKYGEPLPSAFTEKVKVQRFLLYRGYLMEDIQEIWRNFAD

SEQ ID NO: 478 - protein, 168 aa, Klebsiella pneumoniae 6258; identical to SEQ ID NO: 461

SEQ ID NO: 479 - protein, 168 aa, Klebsiella pneumoniae 6168; identical to SEQ ID NO: 461

SEQ ID NO: 480 - protein, 168 aa, Klebsiella pneumoniae i256/94; identical to SEQ ID NO: 191

SEQ ID NO: 481 - protein, 168 aa, Klebsiella pneumoniae 7749; identical to SEQ ID NO: 191

SEQ ID NO: 482 - protein, 168 aa, Klebsiella pneumoniae 2482
VPVTEPSSRRSGYARLLDRAIRILAMRDHSEQELRRKLVAPVMSKNGPEALDVTPDELEQVVAWCIENRYLDDNRFVGQFIASRSRKGYGPARIRQELSQKGIARQAVEQAMRECDIDWVSLAREQAQRKYGEPLPSAFTEKVKVQRFLLYRGYLMEDIQEIWRNFAD

SEQ ID NO: 483 - protein, 168 aa, Klebsiella pneumoniae 5281; identical to SEQ ID NO: 191

SEQ ID NO: 484 - protein, 168 aa, Klebsiella pneumoniae i224/94; identical to SEQ ID NO: 469

SEQ ID NO: 485 - protein, 168 aa, Klebsiella pneumoniae 1756/51
VPVTEPSSRRSGYARLLDRAIRILAMRDHSEQELRRKLVAPVMSKNGPEALDVTPEELEQVVAWCIENRYLDDHRFVGQFIASRSRKGYGPARIRQELSQKGIARQDVDQAMRECDIDWVSLAREQAQRKYGEPLPSAFTEKVKVQRFLLYRGYLMEDIQEIWRNFAD

SEQ ID NO: 486 - protein, 168 aa, Klebsiella pneumoniae Stanley
VPVTEPSSRRSGYARLLDRAIRILAMRDHSEQELRRKLAAPVMSKNGPEALDVTPEELEQVVAWCIENRYLDDHRFVGQFIASRSRKGYGPARIRQELSQKGIARQDVEQAMRECDIDWVSLAREQAQRKYGEPLPSAFTEKVKVQRFLLYRGYLMEDIQEIWRNFAD

SEQ ID NO: 487 - protein, 168 aa, Klebsiella pneumoniae 3985/51; identical to SEQ ID NO: 461

SEQ ID NO: 488 - protein, 168 aa, Klebsiella pneumoniae i221/94; identical to SEQ ID NO: 461

SEQ ID NO: 489 - protein, 168 aa, Klebsiella pneumoniae 4463/52
VPVTEPSSRRSGYARLLDRAIRILAMRDHSEQELRRKLAAPVMSKNGPEALDVIPEELEQVVAWCIENRYLDDNRFVGQFIASRSRKGYGPARIRQELSQKGIARQAVEQAMRECDIDWVSLARAQAQRKYGEPLPSAFAEKVKIQRFLLYRGYLMEDIQEIWRNFAD

SEQ ID NO: 490 - protein, 168 aa, Klebsiella pneumoniae 5710/52
VPVTEPSSRRSGYARLLDRAIRILAMRDHSEQELRRKLDAPVMSKNGPEALDVTPDELEQVVAWCIENRYLDDNRFVGQFIASRSRKGYGPARIRQELSQKGIARQVVDQAMRECDIYWVSLAREQAQRKYGEPLPSAFTEKVKVQRFLLYRGYLMEDIQEIWRNFAD

SEQ ID NO: 491 - protein, 168 aa, Klebsiella pneumoniae 5711/52; identical to SEQ ID NO: 191

SEQ ID NO: 492 - protein, 168 aa, Klebsiella pneumoniae 5845/52; identical to SEQ ID NO: 474

SEQ ID NO: 493 - protein, 168 aa, Klebsiella pneumoniae NCTC8172; identical to SEQ ID NO: 191

SEQ ID NO: 494 - protein, 168 aa, Klebsiella pneumoniae 264-1
LTVTETSSRRSDYARLLDRAIRILAMRDHSEQELRRKLAAPVMSKNGPEALDVTPEEVDKVVEWCIENRYLDDERFVRQFIASRSRKGYGPARVRQELKQKGISRETTEAAMRECEIDWARLAKEQAQRKYGEPLPSVFAEKVKIQRFLLYRGYLMEDIQEIWRNFAD

SEQ ID NO: 495 - protein, 168 aa, Klebsiella pneumoniae 265-1
VPVTESSSRRSGYARLLDRAIRILAMRDHSEQELRRKLAAPVMGKNGPEALDVTPEEVDRVVAWCIENRYLDDQRFVRQFIASRSRKGYGPARIRQELNQKGIAREEGERAMRECEIDWALLAKEQAQRKYGDPLPTVFAEKVKIQRFLLYRGYLMEDIQEIWRNFAD

SEQ ID NO: 496 - protein, 168 aa, Klebsiella pneumoniae 889
VPVTESTSRRSGYARLLDRAIRILAMRDHSEQELRRKLAAPVMGKNGPEALDVTPEEVDRVVAWCIENRYLDDQRFVRQFIASRSRKGYGPARIRQELNQKGIAREEGERAMRECEIDWALLAKEQAQRKYGDPLPTVFAEKVKIQRFLLYRGYLMEDIQEIWRNFAD

SEQ ID NO: 497 - protein, 168 aa, Klebsiella pneumoniae 708; identical to SEQ ID NO: 453

SEQ ID NO: 498 - protein, 168 aa, Klebsiella pneumoniae 370; identical to SEQ ID NO: 453

SEQ ID NO: 499 - protein, 168 aa, Klebsiella pneumoniae Friedlaender204; identical to SEQ ID NO: 191

SEQ ID NO: 500 - protein, 168 aa, Klebsiella pneumoniae 5053; identical to SEQ ID NO: 453

SEQ ID NO: 501 - protein, 397 aa, Klebsiella pneumoniae MGH78578; identical to SEQ ID NO: 235

SEQ ID NO: 502 - protein, 397 aa, Klebsiella pneumoniae A5054
VVRFDAVVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECGKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALMEG

SEQ ID NO: 503 - protein, 397 aa, Klebsiella pneumoniae B5055
VERFDAVVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 504 - protein, 397 aa, Klebsiella pneumoniae i225/94
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLTAKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 505 - protein, 397 aa, Klebsiella pneumoniae D5050
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGDVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACVQALVEG

SEQ ID NO: 506 - protein, 397 aa, Klebsiella pneumoniae E5051
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGDVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 507 - protein, 397 aa, Klebsiella pneumoniae Aerogenes4140
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEE

SEQ ID NO: 508 - protein, 397 aa, Klebsiella pneumoniae 1015
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEMMDVTGWLGGYNFQWAWSSAWACAQALVEG

SEQ ID NO: 509 - protein, 397 aa, Klebsiella pneumoniae Mich61
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 510 - protein, 397 aa, Klebsiella pneumoniae 2069/49
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVESDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGELMDVTGWLGGYNFQWAWSSAWACAQALVEG

SEQ ID NO: 511 - protein, 397 aa, Klebsiella pneumoniae i243/94
VERFDAIVVGDRAAGMFCTPDAGPLGCRVLLVDKGIKMGRKILMAGGGRCNFTNMYVEPAAYLSQNPHFCKSALARYTQWDFIELVGKYGIAWHEKTLGQLFCDDSAEQIVNLLLAECEKGDVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCNLEDFLNEQRSAHPNQSLKNTLAMQLPKRLVECLQQLGQIPDVTLKQLNVRDQQTLVETLTAWRVQPNGTEGYRTAEVTLGGVDTNELSSRTTEARKASGLYFIGEMMDVTGRLGRYKTQSAWSSLHASYQAHQEG

SEQ ID NO: 512 - protein, 397 aa, Klebsiella pneumoniae 2005/49; identical to SEQ ID NO: 504

SEQ ID NO: 513 - protein, 397 aa, Klebsiella pneumoniae 1754/49
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQLTLVETLTAWRVQPNGTEGYRTAEVTLGGVDTNELSSRTMEARKAPGLYFIGEVMDVTGWLGGYNFQWAWSSAWACAQALVEG

SEQ ID NO: 514 - protein, 397 aa, Klebsiella pneumoniae 1702/49; identical to SEQ ID NO: 509

SEQ ID NO: 515 - protein, 397 aa, Klebsiella pneumoniae i202/94
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVTLLLAECEKGGVQIRLRSEILSVERDEQGYRLQVNGETLATKKLVIASGGLSMPGLGASPFGYKIAEQFGLKVLPTRAGLVPFTLHKPLLEQLQVLSGVSVPSTITAENGTLFRENLLFTHRGLSGPAVLQISSYWQPGEFVTVNLLPDCNLEEFLNEQRGAHPNQSLKNTLAMQLPKRLVECLQQLGQIPDVTLKQLNVRDQQALVETLTAWRVQPNGTEGYRTAEVTLGGVDTNELSSRTMEARKAPGLYFIGEVMDVTGWLGGYNFQWAWSSAWACAQALVEG

SEQ ID NO: 516 - protein, 397 aa, Klebsiella pneumoniae 1996/49; identical to SEQ ID NO: 509

SEQ ID NO: 517 - protein, 397 aa, Klebsiella pneumoniae 1680/49; identical to SEQ ID NO: 509

SEQ ID NO: 518 - protein, 397 aa, Klebsiella pneumoniae 2002/49; identical to SEQ ID NO: 509

SEQ ID NO: 519 - protein, 397 aa, Klebsiella pneumoniae 6613
VVRIDAVVVGAGAAGMFCAAQAGQLGCRVLLLDNGRKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGDMMDVTGWLGGYNFQWPWSSAWACAQALVEG

SEQ ID NO: 520 - protein, 397 aa, Klebsiella pneumoniae 5725y
VERFDAIVVGAGAAGMFCAAQAGQLGCRVLLLDNGKKPGRKILMSGGGRCNFTNMYVEPAAYLSQNPHFCKSALGRYTHWDFIELVGKYGIPRHEKTLRQLFCDDSAEQIVNLLLAECEKGGVQIRLRSEILLVERDEQGYRLQVNGETLMTKKLVIASGGLSMPGLGASPFGYKVAEQFGLKVLPTRAGLVPFTLHKPLLEQLQVLSGVTVPSTITAENGTLFRENLMFTHRGLSGTAGLQISSYWQPGEFVTVNLLTDCDLDDFLYEQRSAHPHQSLKKTLAMPLPKRLVERLQQLGQIPDVTLKQLNVPDQQTLVEKLTAWRVQPNGTEGYRTAEVTLGGVDTNELSSRTMEARKGPGLSFIGEVMDLTGWLGGYNFQWAWSSAWACAQALVEG

SEQ ID NO: 521 - protein, 397 aa, Klebsiella pneumoniae 7824; identical to SEQ ID NO: 507

SEQ ID NO: 522 - protein, 397 aa, Klebsiella pneumoniae 6258; identical to SEQ ID NO: 509

SEQ ID NO: 523 - protein, 397 aa, Klebsiella pneumoniae 6168; identical to SEQ ID NO: 509

SEQ ID NO: 524 - protein, 397 aa, Klebsiella pneumoniae i256/94; identical to SEQ ID NO: 509

SEQ ID NO: 525 - protein, 397 aa, Klebsiella pneumoniae 7749; identical to SEQ ID NO: 509

SEQ ID NO: 526 - protein, 397 aa, Klebsiella pneumoniae 2482
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVEIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 527 - protein, 397 aa, Klebsiella pneumoniae 5281; identical to SEQ ID NO: 503

SEQ ID NO: 528 - protein, 397 aa, Klebsiella pneumoniae i224/94
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVEHDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 529 - protein, 397 aa, Klebsiella pneumoniae 1756/51
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGDVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCNLEDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKASGLYFIGEVMDVTGWLGGYNFQWAWSSAWACAQALVEG

SEQ ID NO: 530 - protein, 397 aa, Klebsiella pneumoniae Stanley; identical to SEQ ID NO: 529

SEQ ID NO: 531 - protein, 397 aa, Klebsiella pneumoniae 3985/51; identical to SEQ ID NO: 528

SEQ ID NO: 532 - protein, 397 aa, Klebsiella pneumoniae i221/94
VERFDAIVVGAGAAGMFCAAHAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 533 - protein, 397 aa, Klebsiella pneumoniae 4463/52
VERFDAIVIGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVTLLLAECEKGGVQIRLRSEILSVERDEQGYRLQVNGETLATKKLVIASGGLSMPGLGASPFGYKIAEQFGLKVLPTRAGLVPFTLHKPLLEQLQVLSGVSVPSTITAENGTLFRENLLFTHRGLSGPAVLQISSYWQPGEFVTVNLLPDCNLEEFLNEQRGAHPNQSLKNTLAMQLPKRLVECLQQLGQIPDVTLKQLNVRDQQALVETLTAWRVQPNGTEGYRTAEVTLGGVDTNELSSRTMEARKAPGLFFIGEVMDVTGWLGGYNFQWAWSSAWACAQALVEG

SEQ ID NO: 534 - protein, 397 aa, Klebsiella pneumoniae 5710/52; identical to SEQ ID NO: 509

SEQ ID NO: 535 - protein, 397 aa, Klebsiella pneumoniae 5711/52
VERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 536 - protein, 397 aa, Klebsiella pneumoniae 5845/52
VERFDAIVVGAGAAGMFCAAQAGQLGCHVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 537 - protein, 397 aa, Klebsiella pneumoniae NCTC8172; identical to SEQ ID NO: 528

SEQ ID NO: 538 - protein, 397 aa, Klebsiella pneumoniae 708; identical to SEQ ID NO: 509

SEQ ID NO: 539 - protein, 397 aa, Klebsiella pneumoniae 370; identical to SEQ ID NO: 509

SEQ ID NO: 540 - protein, 397 aa, Klebsiella pneumoniae 5053
VERFDAIVVGAGAAGMFCAAHAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVERDEQGYRLQVNGETLVTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEMMDVTGWLGGYNFQWAWSSAWACAQALVEG

SEQ ID NO: 541 - protein, 847 aa, Klebsiella pneumoniae MGH78578; identical to SEQ ID NO: 240

SEQ ID NO: 542 - protein, 847 aa, Klebsiella pneumoniae A5054
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPATQTRFKHFINSDQRDPNVQVVPERDQHRPATPYERIPVTLVEEKA

SEQ ID NO: 543 - protein, 847 aa, Klebsiella pneumoniae B5055
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 544 - protein, 847 aa, Klebsiella pneumoniae i225/94; identical to SEQ ID NO: 240

SEQ ID NO: 545 - protein, 847 aa, Klebsiella pneumoniae D5050
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCELAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPKIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 546 - protein, 847 aa, Klebsiella pneumoniae E5051; identical to SEQ ID NO: 545

SEQ ID NO: 547 - protein, 847 aa, Klebsiella pneumoniae Aerogenes4140
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEKKA

SEQ ID NO: 548 - protein, 847 aa, Klebsiella pneumoniae 1015; identical to SEQ ID NO: 543

SEQ ID NO: 549 - protein, 847 aa, Klebsiella pneumoniae 919; identical to SEQ ID NO: 543

SEQ ID NO: 550 - protein, 847 aa, Klebsiella pneumoniae 313; identical to SEQ ID NO: 543

SEQ ID NO: 551 - protein, 847 aa, Klebsiella pneumoniae 1470
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSAHNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 552 - protein, 847 aa, Klebsiella pneumoniae 1193
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKTAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 553 - protein, 847 aa, Klebsiella pneumoniae Mich61; identical to SEQ ID NO: 543

SEQ ID NO: 554 - protein, 847 aa, Klebsiella pneumoniae 2069/49; identical to SEQ ID NO: 543

SEQ ID NO: 555 - protein, 847 aa, Klebsiella pneumoniae i243/94
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEICKPTVGSLLASCWNEYILKPQHTPLQDTNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEENV

SEQ ID NO: 556 - protein, 847 aa, Klebsiella pneumoniae 2005/49
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEVVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 557 - protein, 847 aa, Klebsiella pneumoniae 1754/49; identical to SEQ ID NO: 543

SEQ ID NO: 558 - protein, 847 aa, Klebsiella pneumoniae 1702/49; identical to SEQ ID NO: 240

SEQ ID NO: 559 - protein, 847 aa, Klebsiella pneumoniae i202/94
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGIEARKTMRFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLAKHGQGYGCEVCKPTVGSLLASCWNEYILKPQHTPLQDTNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLITYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 560 - protein, 847 aa, Klebsiella pneumoniae 1996/49; identical to SEQ ID NO: 543

SEQ ID NO: 561 - protein, 847 aa, Klebsiella pneumoniae 1680/49
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFGELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWQQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFAWEWTETVNNPAAQTRFKHFINSDQRDPNVQVVPERDQHRPATPYERIPVTLVEEKA

SEQ ID NO: 562 - protein, 847 aa, Klebsiella pneumoniae 2002/49; identical to SEQ ID NO: 543

SEQ ID NO: 563 - protein, 847 aa, Klebsiella pneumoniae 6613; identical to SEQ ID NO: 543

SEQ ID NO: 564 - protein, 847 aa, Klebsiella pneumoniae 5758; identical to SEQ ID NO: 543

SEQ ID NO: 565 - protein, 847 aa, Klebsiella pneumoniae 6258; identical to SEQ ID NO: 543

SEQ ID NO: 566 - protein, 847 aa, Klebsiella pneumoniae 6168; identical to SEQ ID NO: 543

SEQ ID NO: 567 - protein, 847 aa, Klebsiella pneumoniae i256/94; identical to SEQ ID NO: 543

SEQ ID NO: 568 - protein, 847 aa, Klebsiella pneumoniae 7749
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERNQHRPATPYERIPVTLVEEKA

SEQ ID NO: 569 - protein, 847 aa, Klebsiella pneumoniae i224/94; identical to SEQ ID NO: 543

SEQ ID NO: 570 - protein, 847 aa, Klebsiella pneumoniae 1756/51; identical to SEQ ID NO: 555

SEQ ID NO: 571 - protein, 847 aa, Klebsiella pneumoniae 3985/51; identical to SEQ ID NO: 240

SEQ ID NO: 572 - protein, 847 aa, Klebsiella pneumoniae i221/94; identical to SEQ ID NO: 543

SEQ ID NO: 573 - protein, 847 aa, Klebsiella pneumoniae 4463/52; identical to SEQ ID NO: 559

SEQ ID NO: 574 - protein, 847 aa, Klebsiella pneumoniae 5710/52; identical to SEQ ID NO: 543

SEQ ID NO: 575 - protein, 847 aa, Klebsiella pneumoniae 5711/52; identical to SEQ ID NO: 543

SEQ ID NO: 576 - protein, 847 aa, Klebsiella pneumoniae NCTC8172
MSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSATNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRETLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 577 - protein, 847 aa, Klebsiella pneumoniae 370; identical to SEQ ID NO: 543

SEQ ID NO: 578 - protein, 847 aa, Klebsiella pneumoniae Friedlaender204; identical to SEQ ID NO: 543

SEQ ID NO: 579 - protein, 847 aa, Klebsiella pneumoniae 5053; identical to SEQ ID NO: 543

SEQ ID NO: 580 - protein, 1663 aa, Klebsiella pneumoniae MGH78578; identical to SEQ ID NO: 241

SEQ ID NO: 581 - protein, 1254 aa, Klebsiella pneumoniae A5054
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAFSGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGDAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALW

SEQ ID NO: 582 - protein, 951 aa, Klebsiella pneumoniae i252/94
VIICIRPTGRGVRRMKPFRLAALSLALLTAFSLTGCDDSGTPQATAPAPAADSNPGATAKPDRVQLAALAEKSQGKALTLIDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLNDIKPLQQPGVYVAVMNPAGHYSYSNAATLFTLSDIGVSAHRYHNRLDVFTQSLENGAAQSGIDVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADAKGEKKAISGLQVRLIRERRDYYWNWSDSEGWQSQFDQKDLQEGEESLDLQAGQTGKVSFPVEWGSYRLEVKGPDDVVSSVRFWAGYSWQDNSEGTGAARPDRVTMKLDKPSYKPGDTIKLHIAAPAAGKGYAMVESSEGPLWWQEIDVPAEGMDLSIPVDKAWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQG

SEQ ID NO: 583 - protein, 1403 aa, Klebsiella pneumoniae B5055
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLCFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKL

SEQ ID NO: 584 - protein, 1454 aa, Klebsiella pneumoniae i225/94
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALTGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGS

SEQ ID NO: 585 - protein, 1492 aa, Klebsiella pneumoniae D5050
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIRPESLSALVSQWEYRNSLSNWESDELLNMADLVYSGRFDLNPARHTREKLLLPLSDIKPLQQPGVYLAVMNPAGRYIYINAATLFTLIDIGVSAHRYHNRLDVFTHTLENGAAQSGIEVQLLNAKGQTLAEAKSDSQGHVTLQTDKKAALLLARKEGKTTLLDLKLPALDLAEFSIAGAPGFRKQFVMFGPRDPYRPGETVILNALLRDSDGKPLAEQPVKLEVVQPDGQVIRSVMSKPVNGLYQFTYPLDSGAATGMWHIRASAGDNQPREWDFYVEDFMPERMALNLTPQAAPVAPDADVTFGVSGAYLYGAPASGNQLQAKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQTQLLSTLSEEAYGQRWLSTQETNALFLAGRTLADLPGSWQAQTSLQAEPLAGDKAQTRNLDGDRLAALQVSNTGSQ

SEQ ID NO: 586 - protein, 1463 aa, Klebsiella pneumoniae E5051
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQAKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQPLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNDLKLALLEENKLLPEVQTQLLSTLSEEAYGQRWLSTQETNALFLAGRTLADLPGSWQAQTSLQA

SEQ ID NO: 587 - protein, 1492 aa, Klebsiella pneumoniae Aerogenes4140
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDQPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLDNGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQTQLLSTLSEEAYGQRWLSTQETNALFLAGRTLADLPGSWQAQTSLQAEPLAGDKAQTRNLDGDRLAALQVSNTGSQ

SEQ ID NO: 588 - protein, 1457 aa, Klebsiella pneumoniae 1015
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALAGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPGYKPGDTIRLHIAAPAAGKGYAMVESSEGPLWWQEIDVPAEGMDLSIPVDKAWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALTGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQA

SEQ ID NO: 589 - protein, 1489 aa, Klebsiella pneumoniae i262/94
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTSRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKQSTVHKAEVSIAGAPVFSRQFRNPVRLLLRRAGETVLLHALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLSEGQLPPVQLAPGARSTLFIPVSALAGFGDGQVNATISGLSLPGETFAPLQKQWKIGVRPAYPAQTVNSGAVLQPGESWQPPAAQTAGFAAQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNT

SEQ ID NO: 590 - protein, 1476 aa, Klebsiella pneumoniae 919
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTSRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKQSALHKAKVSIAALSGFSRHIRNPVRLLLRRAGETELLHALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAQTRNL

SEQ ID NO: 591 - protein, 1490 aa, Klebsiella pneumoniae 313
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPSFSKHFFISGPRVLFRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMHLENGGFALWDREGPEEYWLTAYAMDFLVRASEQGYSVPGNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNTG

SEQ ID NO: 592 - protein, 1490 aa, Klebsiella pneumoniae 1470
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDQPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQTQLLSTLSEEAYGQRWLSTQETNALFLAGRTLADLPGSWQAQTSLQAEPLAGDKAQTRNLDGDRLAALQVSNTG

SEQ ID NO: 593 - protein, 1492 aa, Klebsiella pneumoniae 1193
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHKRLDVFTQSLENGAAQSGIEVQLLNAKGQTLAEAKSDSQGHVTLQTDKEAALLLARKEGQTTLLDLKVPALDLAEFSSAAAPGFSKQSFMFVPRGLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLSEGQLPPVQLAPAARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPYLYTSAAQLKALGISGDSDEKRRAAIDVGISRLLQMQLENGGFALWDREGAEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNTGSQ

SEQ ID NO: 594 - protein, 1490 aa, Klebsiella pneumoniae Mich61
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAVQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQESEESLDLQAGQIGKVSFPVEWGSYRLEVKGPDDVVSSVRFWAGYSWQDNSEGAGAARPDRVTMKLDKPGYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLCGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAIATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVSNTA

SEQ ID NO: 595 - protein, 1491 aa, Klebsiella pneumoniae 2069/49
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTSRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPGYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFSPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVSNTGS

SEQ ID NO: 596 - protein, 1489 aa, Klebsiella pneumoniae 2005/49
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVCFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLSEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKSPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAIATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNT

SEQ ID NO: 597 - protein, 1419 aa, Klebsiella pneumoniae 1702/49
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAIATPRQDENRWLGDYGSPLRDNALKLALLEENKLLPEVLKAL

SEQ ID NO: 598 - protein, 1489 aa, Klebsiella pneumoniae 1996/49
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVTALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDQPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQTQLLSTLSEEAYGQRWLSTQETNALFLAGRTLADLPGSWQAQTSLQAEPLAGDKAQTRNLDGDRLAALQVSNT

SEQ ID NO: 599 - protein, 1484 aa, Klebsiella pneumoniae 1680/49
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMSLNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVRAEGMDLSIPVDKTWNRHDLYLSTLVVRPGDKSRSATPKRAVGLLHLPLGDENRRLTLALEAPDKMRPNQPLTVKVKASVKEGEAPKRVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLSEGQLPPVQLAPGARSTLFIPVSALAGFGDGQVNATISGLSLPGETFAPLQKQWIIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQPLLQAEPLAGDKPQTGSRDGDQLAAL

SEQ ID NO: 600 - protein, 1489 aa, Klebsiella pneumoniae 2002/49
VTNCIRLIGRGVRRMKPFRLAALSLALLTAFSLTGCDDSGTPQASAPAPAADSNPGATAKPDRAQLAALAEKSRGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGWPRAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMNLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQTQLLSTLSEEAYGQRWLSTQETNALFLAGRTLADLPGSWQAQTSLQAEPLAGDKAQTRNLDGDRLAALQVSNT

SEQ ID NO: 601 - protein, 1482 aa, Klebsiella pneumoniae 6613
VTNCIRLIGRGVRRMKPFRLAALSLALLTAFSLTGCDDSGTPQASAPAPAATAKPDLAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLEVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAPRNLDGDRLAALQVSNT

SEQ ID NO: 602 - protein, 1240 aa, Klebsiella pneumoniae 5758
VTNCIRLIGRGVRRMKPFRLAALSLALLTAFSLTGCDDSGTPQASAPAPAATAKPDLAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLEVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGATVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQL

SEQ ID NO: 603 - protein, 1492 aa, Klebsiella pneumoniae 7824
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIVEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKRVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNTGSQ

SEQ ID NO: 604 - protein, 1423 aa, Klebsiella pneumoniae 6258
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKRVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTL

SEQ ID NO: 605 - protein, 1491 aa, Klebsiella pneumoniae 6168
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQESEESLDLQAGQIGKVSFPVEWGSYRLEVKGPDDVVSSVRFWAGYSWQDNSEGAGAARPDRVTMKLDKPGYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNTGS

SEQ ID NO: 606 - protein, 1489 aa, Klebsiella pneumoniae i256/94
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKRVNVLLSAVDSGALNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVSNT

SEQ ID NO: 607 - protein, 1492 aa, Klebsiella pneumoniae 7749
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPMKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAIAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTMKQPVVDENSNAAFDIVYADVKGEKKATSGLQVRLIRERRDYYWNWSDSEGWQSQFDQKDLLEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGENWQPPAAQSQGFAPQTQQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVSNTGSQ

SEQ ID NO: 608 - protein, 1492 aa, Klebsiella pneumoniae 2482
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGGAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQDTNALFLAGRTLADLPGSWQAQTSLQAEPLAGDKAQTRNLDGDRLAALQVSNTGSQ

SEQ ID NO: 609 - protein, 1492 aa, Klebsiella pneumoniae 5281
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKAWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQDTNALFLAGRTLADLPGSWQAQTSLQAEPLAGDKAQTRNLDGDRLAALQVSNSDSQ

SEQ ID NO: 610 - protein, 1492 aa, Klebsiella pneumoniae i224/94
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWNREEPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAIATPRQDENRWLGDYGSPLRDNALKLALLEENKLLPEVQNQLLSTLSEEAYGQRWLSTQETNALFLAGRTLADLPGSWQAQTSLQAEPLAGDKAQTRNLDGDRLAALQVSNTGSQ

SEQ ID NO: 611 - protein, 1487 aa, Klebsiella pneumoniae i221/94
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKQLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAIATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVS

SEQ ID NO: 612 - protein, 1489 aa, Klebsiella pneumoniae 5710/52
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSESAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLALLEENKLLPEVQNQLLSTLSEEAYGQRWLSTQETNALFLAGRTLADLPGSWQAKTSLQAEPLAGDKAQTRNLDGDRLAALQVSNT

SEQ ID NO: 613 - protein, 1490 aa, Klebsiella pneumoniae 5711/52
VTNSIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAFSGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDQPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMHLENGGFALWDKKGPEKYWLTAYPMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDPPLKLAVATPPQDENRWLGDYGSPLRDNALKLALLEENKLLPEVQTQLLSTLSEEAYGQRWLSTQETNALFLAGRTLADLPGSWQAQTSLQAEPLAGDKAQTRNLDGDRLAALQVSNTG

SEQ ID NO: 614 - protein, 1252 aa, Klebsiella pneumoniae NCTC8172
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEDEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKRVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFA

SEQ ID NO: 615 - protein, 949 aa, Klebsiella pneumoniae 708
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKRVNVLLSAVDSGVLNITDYATPDPWNAFFGQKRYGADIYDIYGQVIEG

SEQ ID NO: 616 - protein, 1244 aa, Klebsiella pneumoniae Friedlaender204
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYLTDTTVKQPVVDENSNAAFDIVYADVKGEKKAISGLQVRLIRERRDYYWNWSDSEGWQSQFDQKDLQEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLSEGQLPPVQLAPGARSTLFIPVSALAGFGDGQVNATISGLSLPGETFAPLQKQWKIGVRPAYPAQTVNSGAALQPGESWQPPAAQSQGFAPQTLQGQLLLSGKPPLNLARYIRELKAYPYGCLEQTASGLFPSLYTSAAQLKALGISGDSDEKRRAAIDVGISRLLQM

SEQ ID NO: 617 - protein, 1474 aa, Klebsiella pneumoniae 5053
VTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKATLDKPFEKTLTTRDIAPSVGFASRGSLLPGNVVAGLPVMALNVDNVDVNFFRIKPESLSAFVSQWEYRNSLSNWESDELLKMADLVYTGRFDLNPARNTREKLLLPLSDIKPLQQPGVYVAVMNPAGRYSYSNAATLFTLSDIGVSAHRYHNRLDVFTQSLENGAVQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTVKQPVVDENSNAAFDIVYADVKGEKKAISGLQVRLIRERRDYYWNWSDSEGWQSQFDQKDLQESEESLDLQAGQIGKVSFPVEWGSYRLEVKGPDDVVSSVRFWAGYSWQDNSEGAGAARPDRVTMKLDKPGYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKIRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTEGQLPPVQLAPGARSTLFIPVSALAGFGDGQVNATISGLSLPGETFAPLQKQWKIGVRPAYPAQTVNSGAVLQPGESWQPPAAQSQGFAPQTLQGQLLLCGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAIATPRQDENRWLGDYGSPLRDNALKLALLEENKLLPEVQNQLLSTLSEEAYGQRWLSTQETNALFLAGRTLADLPGSWQAKTSLQAEPLAGDKAQTR

SEQ ID NO: 618 - protein, 245 aa, Klebsiella pneumoniae MGH78578; identical to SEQ ID NO: 195

SEQ ID NO: 619 - protein, 245 aa, Klebsiella pneumoniae A5054; identical to SEQ ID NO: 195

SEQ ID NO: 620 - protein, 245 aa, Klebsiella pneumoniae i252/94
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGTSGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTNND

SEQ ID NO: 621 - protein, 245 aa, Klebsiella pneumoniae B5055; identical to SEQ ID NO: 195

SEQ ID NO: 622 - protein, 245 aa, Klebsiella pneumoniae i225/94; identical to SEQ ID NO: 195

SEQ ID NO: 623 - protein, 245 aa, Klebsiella pneumoniae D5050; identical to SEQ ID NO: 195

SEQ ID NO: 624 - protein, 245 aa, Klebsiella pneumoniae E5051; identical to SEQ ID NO: 195

SEQ ID NO: 625 - protein, 245 aa, Klebsiella pneumoniae Aerogenes4140; identical to SEQ ID NO: 195

SEQ ID NO: 626 - protein, 245 aa, Klebsiella pneumoniae 1015; identical to SEQ ID NO: 195

SEQ ID NO: 627 - protein, 245 aa, Klebsiella pneumoniae i262/94
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGTSGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPSRKARADNTNND

SEQ ID NO: 628 - protein, 245 aa, Klebsiella pneumoniae 919; identical to SEQ ID NO: 195

SEQ ID NO: 629 - protein, 245 aa, Klebsiella pneumoniae 313; identical to SEQ ID NO: 195

SEQ ID NO: 630 - protein, 245 aa, Klebsiella pneumoniae 1470
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKTRADNTNND

SEQ ID NO: 631 - protein, 245 aa, Klebsiella pneumoniae 1193; identical to SEQ ID NO: 195

SEQ ID NO: 632 - protein, 245 aa, Klebsiella pneumoniae Mich61; identical to SEQ ID NO: 195

SEQ ID NO: 633 - protein, 245 aa, Klebsiella pneumoniae 2069/49; identical to SEQ ID NO: 195

SEQ ID NO: 634 - protein, 245 aa, Klebsiella pneumoniae i243/94; identical to SEQ ID NO: 627

SEQ ID NO: 635 - protein, 245 aa, Klebsiella pneumoniae 2005/49; identical to SEQ ID NO: 195

SEQ ID NO: 636 - protein, 245 aa, Klebsiella pneumoniae 1754/49; identical to SEQ ID NO: 195

SEQ ID NO: 637 - protein, 245 aa, Klebsiella pneumoniae 1702/49; identical to SEQ ID NO: 195

SEQ ID NO: 638 - protein, 245 aa, Klebsiella pneumoniae i202/94
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTKND

SEQ ID NO: 639 - protein, 245 aa, Klebsiella pneumoniae 1996/49; identical to SEQ ID NO: 195

SEQ ID NO: 640 - protein, 245 aa, Klebsiella pneumoniae 1680/49; identical to SEQ ID NO: 195

SEQ ID NO: 641 - protein, 245 aa, Klebsiella pneumoniae 2002/49; identical to SEQ ID NO: 195

SEQ ID NO: 642 - protein, 245 aa, Klebsiella pneumoniae 6613
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIAMKPYLGGKPLKSRELFRQFMPARKARADNTNND

SEQ ID NO: 643 - protein, 245 aa, Klebsiella pneumoniae 5758; identical to SEQ ID NO: 642

SEQ ID NO: 644 - protein, 245 aa, Klebsiella pneumoniae 7824; identical to SEQ ID NO: 195

SEQ ID NO: 645 - protein, 245 aa, Klebsiella pneumoniae 6258
VDGWQRAFVLHSRPWSETSLMLDVFTEESGRVRLVAKGARSKRSNLKGALQPFTPLLVRFGGRGEVKTLRSAEAVSLALPLNGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTNND

SEQ ID NO: 646 - protein, 245 aa, Klebsiella pneumoniae 6168; identical to SEQ ID NO: 195

SEQ ID NO: 647 - protein, 245 aa, Klebsiella pneumoniae i256/94
VDGWQRAFVLHSRPWSETSLMLDVFTEESGRVRLVAKGARSKRSNLKGALQSFTPLLVRFGGRGEVKTLRSAEAVSLALPLSGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTNND

SEQ ID NO: 648 - protein, 245 aa, Klebsiella pneumoniae 7749; identical to SEQ ID NO: 195

SEQ ID NO: 649 - protein, 245 aa, Klebsiella pneumoniae 2482; identical to SEQ ID NO: 195

SEQ ID NO: 650 - protein, 245 aa, Klebsiella pneumoniae 5281; identical to SEQ ID NO: 195

SEQ ID NO: 651 - protein, 245 aa, Klebsiella pneumoniae i224/94; identical to SEQ ID NO: 195

SEQ ID NO: 652 - protein, 245 aa, Klebsiella pneumoniae 1756/51
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGTSGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPSRKPRADNTNND

SEQ ID NO: 653 - protein, 245 aa, Klebsiella pneumoniae Stanley; identical to SEQ ID NO: 627

SEQ ID NO: 654 - protein, 245 aa, Klebsiella pneumoniae 3985/51; identical to SEQ ID NO: 645

SEQ ID NO: 655 - protein, 245 aa, Klebsiella pneumoniae i221/94; identical to SEQ ID NO: 195

SEQ ID NO: 656 - protein, 245 aa, Klebsiella pneumoniae 4463/52
VDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGTSGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTKND

SEQ ID NO: 657 - protein, 245 aa, Klebsiella pneumoniae 5710/52; identical to SEQ ID NO: 642

SEQ ID NO: 658 - protein, 245 aa, Klebsiella pneumoniae 5711/52; identical to SEQ ID NO: 195

SEQ ID NO: 659 - protein, 245 aa, Klebsiella pneumoniae 5845/52; identical to SEQ ID NO: 195

SEQ ID NO: 660 - protein, 245 aa, Klebsiella pneumoniae NCTC8172; identical to SEQ ID NO: 195

SEQ ID NO: 661 - protein, 245 aa, Klebsiella pneumoniae 264-1
MEGWQRAFVLHSRPWSETSLMLDVFTEESGRVRLVAKGARSKRSNLKGALQPFTPLLLRFGGRGEVKTLRSAEAVSLALPLSGITLYSGLYVNELLSRVLEHETRFSELFFDYLHCIQSLAGASGSPEPALRRFELALLGHLGYGVDFLHCAGSGEAVDDAMTYRYREEKGFIASVVIDNNTFTGHHLKALASREFPDSDALRAAKRFTRIALKPYLGGKPLKSRELFRQFMPARAARADKTNND

SEQ ID NO: 662 - protein, 245 aa, Klebsiella pneumoniae 265-1
VEGWQRAFVLHSRPWSETSLMLDVFTEESGRVRLVAKGARSKRSSLKGAFQPFTPLLLRFGGRGEVKTLRSAEAVSLALPLSGITLYSGLYVNELLSRVLEHETRFSELFFDYLHCLQALAGASGTPEPALRRFELALLGHLGYGVDFLHCAGSGEAVSDTMTYRYREEKGFIASLVIDNNSFTGHHLKALANREFPDSDALRAAKRFTRIALKPYLGGKPLKSRELFRQFIPARAARADKTNNE

SEQ ID NO: 663 - protein, 246 aa, Klebsiella pneumoniae 889
VEGWQRAFVLHSRPWSETSLMLDVFTEESGRVRLVAKGARSKRSSLKGALQPFTPLLLRFGGRGEVKTLRSAEAVSLALPLSGITLYSGLYVNELLSRVLEHETRFSELFFDYLHCLQALAGASGTPEPALRRFELALLGHLGYGVDFLHCAGSGEAVSDTMTYRYREEKGFIASLVIDNNSFTGHHLKALANREFPDSDALRAAKRFTRIALKPYLGGKPLKSRELFRQFIPARAARADKTNNEQ

SEQ ID NO: 664 - protein, 245 aa, Klebsiella pneumoniae 708; identical to SEQ ID NO: 195

SEQ ID NO: 665 - protein, 245 aa, Klebsiella pneumoniae 370; identical to SEQ ID NO: 195

SEQ ID NO: 666 - protein, 245 aa, Klebsiella pneumoniae Friedlaender204; identical to SEQ ID NO: 195

SEQ ID NO: 667 - protein, 245 aa, Klebsiella pneumoniae 5053; identical to SEQ ID NO: 195

SEQ ID NO: 668 - protein, 248 aa, Klebsiella pneumoniae MGH78578; identical to SEQ ID NO: 263

SEQ ID NO: 669 - protein, 248 aa, Klebsiella pneumoniae A5054; identical to SEQ ID NO: 263

SEQ ID NO: 670 - protein, 248 aa, Klebsiella pneumoniae i252/94
MKSVFKVSLAALTLAFAVSSHAANKTLVVATDTAFVPFEFKQGDKYVGFDVDLWAAIAKELKLDYTLKPMDFSGIIPALQTKNIDLALAGITITDERKKAIDFSDGYYKSGLLVMVNANNNDIKDVKDLNGKVVAVKSGTGSVDYAKANIKTKDLRQFPNIDNAYMELGTGRADAVLHDTPNILYFIKTAGNGKFKAVGESLEAQNYGIAFPKGSDELREKVNGALKTLRENGTYNEIYKKWFGTEPK

SEQ ID NO: 671 - protein, 248 aa, Klebsiella pneumoniae B5055; identical to SEQ ID NO: 263

SEQ ID NO: 672 - protein, 248 aa, Klebsiella pneumoniae i225/94; identical to SEQ ID NO: 263

SEQ ID NO: 673 - protein, 248 aa, Klebsiella pneumoniae D5050
MKSVFKVSLAALTLAFAVSSHAADKTLVVATDTAFVPFEFKQGDKYVGFDVDLWAAIAKELKLDYTLKPMDFSGIIPALQTKNIDLALAGITITDERKKAIDFSDGYYKSGLLVMVNANNNDIKDVKDLNGKVVAVKGGTGSVDYAKANIKTKDLRQFPNIDNAYMELGTGRADAVLHDTPNILYFIKTAGNGKFKAVGDSLEAQNYGIAFPKGSDELREKVNGALKTLRENGTYNEIYKKWFGTEPK

SEQ ID NO: 674 - protein, 248 aa, Klebsiella pneumoniae E5051; identical to SEQ ID NO: 263

SEQ ID NO: 675 - protein, 248 aa, Klebsiella pneumoniae Aerogenes4140; identical to SEQ ID NO: 263

SEQ ID NO: 676 - protein, 248 aa, Klebsiella pneumoniae 1015; identical to SEQ ID NO: 263

SEQ ID NO: 677 - protein, 248 aa, Klebsiella pneumoniae i262/94; identical to SEQ ID NO: 670

SEQ ID NO: 678 - protein, 248 aa, Klebsiella pneumoniae 919; identical to SEQ ID NO: 263

SEQ ID NO: 679 - protein, 248 aa, Klebsiella pneumoniae 313; identical to SEQ ID NO: 263

SEQ ID NO: 680 - protein, 248 aa, Klebsiella pneumoniae 1470; identical to SEQ ID NO: 263

SEQ ID NO: 681 - protein, 248 aa, Klebsiella pneumoniae 1193; identical to SEQ ID NO: 263

SEQ ID NO: 682 - protein, 248 aa, Klebsiella pneumoniae Mich61; identical to SEQ ID NO: 263

SEQ ID NO: 683 - protein, 248 aa, Klebsiella pneumoniae 2069/49; identical to SEQ ID NO: 263

SEQ ID NO: 684 - protein, 248 aa, Klebsiella pneumoniae i243/94; identical to SEQ ID NO: 670

SEQ ID NO: 685 - protein, 248 aa, Klebsiella pneumoniae 2005/49; identical to SEQ ID NO: 263

SEQ ID NO: 686 - protein, 248 aa, Klebsiella pneumoniae 1754/49; identical to SEQ ID NO: 263

SEQ ID NO: 687 - protein, 248 aa, Klebsiella pneumoniae 1702/49; identical to SEQ ID NO: 263

SEQ ID NO: 688 - protein, 248 aa, Klebsiella pneumoniae i202/94; identical to SEQ ID NO: 670

SEQ ID NO: 689 - protein, 248 aa, Klebsiella pneumoniae 1996/49; identical to SEQ ID NO: 670

SEQ ID NO: 690 - protein, 248 aa, Klebsiella pneumoniae 1680/49; identical to SEQ ID NO: 263

SEQ ID NO: 691 - protein, 248 aa, Klebsiella pneumoniae 2002/49; identical to SEQ ID NO: 263

SEQ ID NO: 692 - protein, 248 aa, Klebsiella pneumoniae 6613
MKSVFKVSLAALTLAFAVSSHAANKTLVVATDTAFVPFEFKQGDKYVGFDVDLWAAIAKELKLDYILKPMDFSGIIPALQTKNIDLALAGITITDERKKAIDFSDGYYKSGLLVMVNANNNDIKDVKDLNGKVVAVKSGTGSVDYAKANIKTKDLRQFPNIDNAYMELGTGRADAVLHDTPNILYFIKTAGNGKFKAVGESLEAQNYGIAFPKGSDELREKVNGALKTLRDNGTYNEIYKKWFGTEPK

SEQ ID NO: 693 - protein, 248 aa, Klebsiella pneumoniae 5758; identical to SEQ ID NO: 263

SEQ ID NO: 694 - protein, 248 aa, Klebsiella pneumoniae 7824; identical to SEQ ID NO: 263

SEQ ID NO: 695 - protein, 248 aa, Klebsiella pneumoniae 6258; identical to SEQ ID NO: 263

SEQ ID NO: 696 - protein, 248 aa, Klebsiella pneumoniae 6168; identical to SEQ ID NO: 263

SEQ ID NO: 697 - protein, 248 aa, Klebsiella pneumoniae i256/94; identical to SEQ ID NO: 263

SEQ ID NO: 698 - protein, 248 aa, Klebsiella pneumoniae 7749; identical to SEQ ID NO: 263

SEQ ID NO: 699 - protein, 248 aa, Klebsiella pneumoniae 2482; identical to SEQ ID NO: 263

SEQ ID NO: 700 - protein, 248 aa, Klebsiella pneumoniae 5281; identical to SEQ ID NO: 263

SEQ ID NO: 701 - protein, 248 aa, Klebsiella pneumoniae i224/94; identical to SEQ ID NO: 263

SEQ ID NO: 702 - protein, 248 aa, Klebsiella pneumoniae 1756/51; identical to SEQ ID NO: 670

SEQ ID NO: 703 - protein, 248 aa, Klebsiella pneumoniae Stanley
MKSVFKVSLAALTLAFAVSSHAATKTLVVATDTAFVPFEFKQGDKYVGFDVDLWAAIAKELKLDYTLKPMDFSGIIPALQTKNIDLALAGITITDERKKAIDFSDGYYKSGLLVMVNANNNDIKDVKDLNGKVVAVKSGTGSVDYAKANIKTKDLRQFPNIDNAYMELGTGRADAVLHDTPNILYFIKTAGNGKFKAVGESLEAQNYGIAFPKGSDELREKVNGALKTLRENGTYNEIYKKWFGTEPK

SEQ ID NO: 704 - protein, 248 aa, Klebsiella pneumoniae 3985/51; identical to SEQ ID NO: 263

SEQ ID NO: 705 - protein, 248 aa, Klebsiella pneumoniae i221/94; identical to SEQ ID NO: 263

SEQ ID NO: 706 - protein, 248 aa, Klebsiella pneumoniae 4463/52; identical to SEQ ID NO: 670

SEQ ID NO: 707 - protein, 248 aa, Klebsiella pneumoniae 5710/52; identical to SEQ ID NO: 263

SEQ ID NO: 708 - protein, 248 aa, Klebsiella pneumoniae 5711/52; identical to SEQ ID NO: 263

SEQ ID NO: 709 - protein, 248 aa, Klebsiella pneumoniae 5845/52; identical to SEQ ID NO: 263

SEQ ID NO: 710 - protein, 248 aa, Klebsiella pneumoniae NCTC8172; identical to SEQ ID NO: 263

SEQ ID NO: 711 - protein, 248 aa, Klebsiella pneumoniae 264-1; identical to SEQ ID NO: 673

SEQ ID NO: 712 - protein, 248 aa, Klebsiella pneumoniae 265-1
MKSVLKVSLAALTLAFAVSSQAAEKQLIVATDTAFVPFEFKQGDKYVGFDVDLWAAIAKELKLDYALKPMDFSGIIPALQTKNIDLALAGITITEERKKAIDFSDGYYKSGLLVMVKANNNDIKDVKDLNGKVVAVKGGTGSVDYAKANIKTKDLRQFPNIDNAYMELGTGRADAVLHDTPNILYFIKTAGHGQFKAVGDSLEAQSYGIAFPKGSDELREKVNGALKTLRENGTYNEIYKKWFGTEPK

SEQ ID NO: 713 - protein, 248 aa, Klebsiella pneumoniae 889; identical to SEQ ID NO: 712

SEQ ID NO: 714 - protein, 248 aa, Klebsiella pneumoniae 708; identical to SEQ ID NO: 263

SEQ ID NO: 715 - protein, 248 aa, Klebsiella pneumoniae 370; identical to SEQ ID NO: 263

SEQ ID NO: 716 - protein, 248 aa, Klebsiella pneumoniae Friedlaender204; identical to SEQ ID NO: 263

SEQ ID NO: 717 - protein, 248 aa, Klebsiella pneumoniae 5053; identical to SEQ ID NO: 263

SEQ ID NO: 718 - protein, 633 aa, Klebsiella pneumoniae MGH78578; identical to SEQ ID NO: 268

SEQ ID NO: 719 - protein, 633 aa, Klebsiella pneumoniae A5054
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMLLINDGVVKVPHLLQSTVEDGKPVPWVQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 720 - protein, 633 aa, Klebsiella pneumoniae i252/94
MKLQNSFRDYTAESSLFVRRALVAFLGILLLTGVLVANLYNVQIVRFNDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAVLALVSTPSYDPNLFVDGISSKDYSGLLNDPNTPLVNRATQGVYPPASTVKPYVAVSALSAGVITRNTSLFDPGWWQLPGSDKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMFGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 721 - protein, 633 aa, Klebsiella pneumoniae B5055; identical to SEQ ID NO: 268

SEQ ID NO: 722 - protein, 633 aa, Klebsiella pneumoniae i225/94; identical to SEQ ID NO: 268

SEQ ID NO: 723 - protein, 633 aa, Klebsiella pneumoniae D5050
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMFGVANRGNGTAHKYFASAPYKIAAKSGTAQVFGLKANETYNAHRIAERLRDHKLMTAFAPYNNPQVAVAIILENGGAGPAVGTIMRQILDHIMLGDNNTNLPSENPAVTAGEDQ

SEQ ID NO: 724 - protein, 633 aa, Klebsiella pneumoniae E5051
MKLQNSFRDYTAESSLFVRRALVAFLGILLLTGVLIANLYNVQIVRFDDYQTRSNENRIKPVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHDHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 725 - protein, 633 aa, Klebsiella pneumoniae Aerogenes4140
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAQDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 726 - protein, 633 aa, Klebsiella pneumoniae 1015; identical to SEQ ID NO: 268

SEQ ID NO: 727 - protein, 633 aa, Klebsiella pneumoniae i262/94; identical to SEQ ID NO: 720

SEQ ID NO: 728 - protein, 633 aa, Klebsiella pneumoniae 919; identical to SEQ ID NO: 268

SEQ ID NO: 729 - protein, 633 aa, Klebsiella pneumoniae 313; identical to SEQ ID NO: 268

SEQ ID NO: 730 - protein, 633 aa, Klebsiella pneumoniae 1470; identical to SEQ ID NO: 268

SEQ ID NO: 731 - protein, 633 aa, Klebsiella pneumoniae 1193; identical to SEQ ID NO: 268

SEQ ID NO: 732 - protein, 633 aa, Klebsiella pneumoniae Mich61; identical to SEQ ID NO: 268

SEQ ID NO: 733 - protein, 633 aa, Klebsiella pneumoniae 2069/49; identical to SEQ ID NO: 268

SEQ ID NO: 734 - protein, 633 aa, Klebsiella pneumoniae i243/94; identical to SEQ ID NO: 720

SEQ ID NO: 735 - protein, 633 aa, Klebsiella pneumoniae 2005/49; identical to SEQ ID NO: 268

SEQ ID NO: 736 - protein, 633 aa, Klebsiella pneumoniae 1754/49; identical to SEQ ID NO: 268

SEQ ID NO: 737 - protein, 633 aa, Klebsiella pneumoniae 1702/49; identical to SEQ ID NO: 268

SEQ ID NO: 738 - protein, 633 aa, Klebsiella pneumoniae i202/94
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQHTLDALRDVVDLTDDEIAGFKKERAPSHAFTSIPVKVNLSEVQVVRFAVNQYRFPGVEVKGYKRRYYPYNSALTHVIGYVSKINDKHVDRLDKEGKLANYASTHDIGKLGIERYYDDVLHGQTGYEEVEVNNRGRVIRQLKEVPPQAGRDIYLTLDLKLQQYIETLLAGSRAAVVVTDPRTGAILALVSTPSYDPNLFVDGISSKDYSGLLNDPNTPLVNRATQGVYPPASTVKPYVAVSALSAGVITRNTSLFDPGWWQLPGSEKRYRDWKKWGHGHLNVTKALEESADTYFYQVAYDMGIDRLAEWMSKFGYGHYTGIDLAEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMFGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 739 - protein, 633 aa, Klebsiella pneumoniae 1996/49; identical to SEQ ID NO: 268

SEQ ID NO: 740 - protein, 633 aa, Klebsiella pneumoniae 1680/49; identical to SEQ ID NO: 268

SEQ ID NO: 741 - protein, 633 aa, Klebsiella pneumoniae 2002/49; identical to SEQ ID NO: 268

SEQ ID NO: 742 - protein, 633 aa, Klebsiella pneumoniae 6613; identical to SEQ ID NO: 268

SEQ ID NO: 743 - protein, 633 aa, Klebsiella pneumoniae 5758; identical to SEQ ID NO: 268

SEQ ID NO: 744 - protein, 633 aa, Klebsiella pneumoniae 5725y
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVSHLLQSTVEDGKPVPWVQPHEPPVGDIHSGFWEIAKDGMFGVANRGNGTAHKYFASAPYKIAAKSGTAQVFGLKANETYNAHRIAERLRDHKLMTAFAPYNNPQVAVAIILENGGAGPAVGTIMRQILDHIMLGDNNTNLPSENPAVTAGEDQ

SEQ ID NO: 745 - protein, 633 aa, Klebsiella pneumoniae 7824; identical to SEQ ID NO: 268

SEQ ID NO: 746 - protein, 633 aa, Klebsiella pneumoniae 6258; identical to SEQ ID NO: 268

SEQ ID NO: 747 - protein, 633 aa, Klebsiella pneumoniae 6168; identical to SEQ ID NO: 268

SEQ ID NO: 748 - protein, 633 aa, Klebsiella pneumoniae i256/94; identical to SEQ ID NO: 268

SEQ ID NO: 749 - protein, 633 aa, Klebsiella pneumoniae 7749; identical to SEQ ID NO: 268

SEQ ID NO: 750 - protein, 633 aa, Klebsiella pneumoniae 2482; identical to SEQ ID NO: 268

SEQ ID NO: 751 - protein, 633 aa, Klebsiella pneumoniae 5281; identical to SEQ ID NO: 268

SEQ ID NO: 752 - protein, 633 aa, Klebsiella pneumoniae i224/94; identical to SEQ ID NO: 268

SEQ ID NO: 753 - protein, 633 aa, Klebsiella pneumoniae 1756/51; identical to SEQ ID NO: 720

SEQ ID NO: 754 - protein, 633 aa, Klebsiella pneumoniae Stanley
MKLQNSFRDYTAESSLFVRRALVAFLGILLLTGVLVANLYNVQIVRFNDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAVLALVSTPSYDPNLFVDGISRKDYSGLLNDPNTPLVNRATQGVYPPASTVKPYVAVSALSAGVITRNTSLFDPGWWQLPGSDKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMFGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 755 - protein, 633 aa, Klebsiella pneumoniae 3985/51; identical to SEQ ID NO: 268

SEQ ID NO: 756 - protein, 633 aa, Klebsiella pneumoniae i221/94; identical to SEQ ID NO: 268

SEQ ID NO: 757 - protein, 633 aa, Klebsiella pneumoniae 4463/52
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSGLLNDPNTPLVNRATQGVYPPASTVKPYVAVSALSAGVITRNTSLFDPGWWQLPGSEKRYRDWKKWGHGHLNVTKALEESADTYFYQVAYDMGIDRLAEWMSKFGYGHYTGIDLAEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMFGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 758 - protein, 633 aa, Klebsiella pneumoniae 5710/52; identical to SEQ ID NO: 268

SEQ ID NO: 759 - protein, 633 aa, Klebsiella pneumoniae 5711/52; identical to SEQ ID NO: 268

SEQ ID NO: 760 - protein, 633 aa, Klebsiella pneumoniae 5845/52; identical to SEQ ID NO: 268

SEQ ID NO: 761 - protein, 633 aa, Klebsiella pneumoniae NCTC8172
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWIQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 762 - protein, 633 aa, Klebsiella pneumoniae 708; identical to SEQ ID NO: 268

SEQ ID NO: 763 - protein, 633 aa, Klebsiella pneumoniae 370; identical to SEQ ID NO: 268

SEQ ID NO: 764 - protein, 633 aa, Klebsiella pneumoniae Friedlaender204
MKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESAGTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 765 - protein, 633 aa, Klebsiella pneumoniae 5053; identical to SEQ ID NO: 268

SEQ ID NO: 766 - protein, 11 aa, Artificial Sequence
  Synthetic Peptide
KLKLLLLLKLK

SEQ ID NO: 767 - DNA, 26 bp, Artificial Sequence
  Synthetic Oligonucleotide
  variation (1)..(1): n is inosine
  variation (3)..(3): n is inosine
  variation (5)..(5): n is inosine
  variation (7)..(7): n is inosine
  variation (9)..(9): n is inosine
  variation (11)..(11): n is inosine
  variation (13)..(13): n is inosine
  variation (15)..(15): n is inosine
  variation (17)..(17): n is inosine
  variation (19)..(19): n is inosine
  variation (21)..(21): n is inosine
  variation (23)..(23): n is inosine
  variation (25)..(25): n is inosine
ncncncncncncncncncncncncnc

SEQ ID NO: 768 - protein, 36 aa, Artificial Sequence
  Synthetic Peptide
  variation (22)..(22): Xaa is ornithine
RLAGLLRKGGEKIGEKLKKIGXKIKNFFQKLVPQPE

The invention claimed is:

1. An isolated antigen
(a) having the amino acid sequence of SEQ ID NO: 235 or,
(b) comprising an amino acid sequence having at least 95% sequence identity to the sequence set forth as SEQ ID NO: 235, and wherein the isolated antigen is no more than 397 amino acids in length.

2. The antigen according to claim 1, wherein the antigen comprises an amino acid sequence having at least 96% sequence identity to the sequence set forth as SEQ ID NO: 235, and wherein the isolated antigen is no more than 397 amino acids in length.

3. An isolated antigen, wherein the antigen consists of amino acids 23-397 of SEQ ID NO: 235.

4. An isolated antigen that consists of a fragment of SEQ ID NO: 235 wherein the fragment comprises at least 95% sequence identity to the sequence set forth as amino acids 23-397 of SEQ ID NO: 235, and wherein said fragment is less than 397 amino acids in length.

5. The antigen according to claim 1, wherein the antigen comprises one or more substitutions at positions E2V, F4I, I7V, V9I, A11D, G12R, A19T, A20P, Q21D, Q21H, Q24P, R28H, L32V, N34K, K36I, K36R, P38M, S45A, T60A, A75G, Q79H, A92P, W93R, G99R, N112T, E119G, G122D, Q124E, S133L, R136H, R136S, M151A, M151T, M151V, T152A, V176I, S211T, L229M, P238T, V240G, P259T, D262N, D264E, D265E, N268Y, S272G, N276H, N281K, Q286P, C294R, R312P, Q315L, T316A, T320K, M354T, A359G, P360S, Y363F, Y363S, E367D, V368L, V368M, V371L, W374R, G377R, N379K, F380T, W382S, A383P, A387L, W388H, C390S, A391V, A391Y, L394H, V395M, V395Q or G397E of SEQ ID NO: 235.

6. An isolated antigen consisting of a fragment of SEQ ID NO: 235, wherein said fragment comprises an amino acid sequence selected from the group consisting of:
amino acids 4-12, 15-33, 58-77, 82-89, 98-106, 108-118, 120-135, 141-147, 152-160, 168-215, 225-233, 235-247, 250-264, 284-312, 314-321, 336-343, 359-374, 386-394, 159-218, 158-182, 178-202, and 167-218 of SEQ ID NO:235 and wherein said fragment is less than 397 amino acids in length.

7. An isolated antigen, wherein the antigen consists of amino acids 4-12, 15-33, 58-77, 82-89, 98-106, 108-118, 120-135, 141-147, 152-160, 168-215, 225-233, 235-247, 250-264, 284-312, 314-321, 336-343, 359-374, 386-394, 159-218, 158-182, 178-202, or 167-218 of SEQ ID NO:235.

8. A fusion protein comprising at least 2, at least 3, at least 4, at least 5 or at least 6 of the amino acid sequences of SEQ ID NO:235 as set forth in claim 6, and wherein said fusion protein is less than 397 amino acids in length.

9. A fusion protein comprising the antigen according to claim 1, 3, 4, 6 or 7, further comprising a heterologous amino acid sequence.

10. An immunogenic composition comprising the antigen according to any one of claim 1, 2-5, 6 or 7.

11. An immunogenic composition comprising the fusion protein according to claim 8 or claim 9.

* * * * *